US009623103B2

(12) United States Patent
Fang et al.

(10) Patent No.: US 9,623,103 B2
(45) Date of Patent: Apr. 18, 2017

(54) ARTERIVIRUS PROTEIN AND EXPRESSION MECHANISMS

(71) Applicants: SOUTH DAKOTA BOARD OF REGENTS, Pierre, SD (US); CAMBRIDGE ENTERPRISE LIMITED, Cambridgeshire (GB); ACADEMISCH ZIEKENHUIS LEIDEN, Leiden (NL); UNIVERSITY COLLEGE CORK, Cork (IE)

(72) Inventors: Ying Fang, Pierre, SD (US); Eric John Snijder, Leiden (NL); Andrew E. Firth, Cambridgeshire (GB); John F. Atkins, Cork (IE); Emma Elisabeth Treffers, Leiden (NL); Ali Tas, Leiden (NL); Yanhua Li, Pierre, SD (US)

(73) Assignees: South Dakota Board of Regents, Pierre, SD (US); Cambridge Enterprise Limited, Cambridgeshire (GB); Academisch Ziekenhuis Leiden, Leiden (NL); University College Cork, Cork (IE)

( * ) Notice: Subject to any disclaimer, the term of this patent is extended or adjusted under 35 U.S.C. 154(b) by 0 days.

(21) Appl. No.: 14/413,385

(22) PCT Filed: Jul. 18, 2013

(86) PCT No.: PCT/US2013/051041

§ 371 (c)(1),
(2) Date: Jan. 7, 2015

(87) PCT Pub. No.: WO2014/015116

PCT Pub. Date: Jan. 23, 2014

(65) Prior Publication Data

US 2015/0190495 A1 Jul. 9, 2015

Related U.S. Application Data

(60) Provisional application No. 61/741,425, filed on Jul. 18, 2012.

(51) Int. Cl.

| | |
|---|---|
| ***A61K 39/12*** | (2006.01) |
| ***C12N 7/00*** | (2006.01) |
| ***C07K 16/10*** | (2006.01) |
| ***C07K 14/005*** | (2006.01) |
| ***G06F 19/18*** | (2011.01) |
| *A61K 39/00* | (2006.01) |

(52) U.S. Cl.

CPC ............ *A61K 39/12* (2013.01); *C07K 14/005* (2013.01); *C07K 16/10* (2013.01); *C12N 7/00* (2013.01); *G06F 19/18* (2013.01); *A61K 2039/5254* (2013.01); *A61K 2039/552* (2013.01); *C12N 2770/10011* (2013.01); *C12N 2770/10022* (2013.01); *C12N 2770/10034* (2013.01); *C12N 2770/10062* (2013.01)

(58) Field of Classification Search

None

See application file for complete search history.

(56) References Cited

U.S. PATENT DOCUMENTS

2015/0190495 A1* 7/2015 Fang ...................... A61K 39/12
424/186.1

FOREIGN PATENT DOCUMENTS

WO 2012063212 A1 5/2012

OTHER PUBLICATIONS

Han et al. (Journal of Virology. 2007; 81 (18): 9878-9890).*
Fang et al. (PNAS. Oct. 2012: 109 (43): E2920-E2928).*
Cao et al. (Virology. Feb. 2016; 491: 115-124).*
Fang, Ying, et al, "A Full-Length cDNA Infectious Clone of North American Type 1 Porcine . . . in the Nsp2 Region", Journal of Virology, vol. 80, No. 23, (2006), pp. 11447-11455. Dec. 31, 2006.
Grebennikova, T.V., et al, "Genomic characterization of virulent, attenuated, and revertant passages of a North American porcine reproductive and respiratory syndrome virus strain", Virology, vol. 321, (2004), pp. 383-390. Jan. 4, 2004.
Han, Jun, et al, "Identification of Nonessential Regions of the nsp2 Replicase Protein of Porcine Reproductive and Respiratory Syndrome Virus Strain VR-2332 for Replication in Cell Culture", Journal of Virology, vol. 81, No. 18, (2007), 10 pages. May 23, 2007.
Li, Yufeng, et al, "Genetic analysis of two porcine reproductive and respiratory syndrome viruses with different virulence isolated in China", Arch Virol, vol. 153, (2008), p. 1877-1884. Aug. 25, 2008.
Xu, Zhenming, et al, "Synthesis of a novel hepatitis C virus protein by ribosomal frameshift", The EMBO Journal, vol. 20, No. 14, (2001), pp. 3840-3848. May 25, 2001.
European Patent Office, "Partial European Search Report", issued in connection to International Application No. 15188538.1, mailed on Mar. 1, 2016, 9 pages. Mar. 1, 2016.

(Continued)

*Primary Examiner* — Shanon A Foley
(74) *Attorney, Agent, or Firm* — McKee, Voorhees & Sease, PLC

(57) ABSTRACT

The invention provides the discovery and characterization of a novel arterivirus protein (nsp2TF), whose expression is dependent on −2 ribosomal frameshifting at a site located in the nsp2 coding region. The coding region for the unique TF domain of nsp2TF overlaps the part of ORF1a that encodes the transmembrane region of nsp2 in arteriviruses, including PRRSV, LDV and SHFV. Mutations affecting the expression of nsp2TF impair PRRSV replication and result in a smaller plaque phenotype. Provided herein are arteriviruses that display reduced translation of nsp2TF and/or altered translation of one or more downstream products, arteriviruses in which nsp2TF function is reduced and/or absent, and vaccines comprising said arteriviruses. Also provided herein are diagnostic methods, methods for identifying compounds that inhibit −2 frameshifting, and gene expression tools for eukaryotic systems utilizing −2 frameshifting.

11 Claims, 25 Drawing Sheets

(56) References Cited

OTHER PUBLICATIONS

Ahlquist, Paul, "Parallels Among Positive-Strand RNA Viruses, Reverse-Transcribing Viruses and Double-Stranded RNA Viruses", Nature Reviews: Microbiology, (May 2006), vol. 4, pp. 371-382. May 30, 2006.
Brierley, I., et al., "Mutational Analysis of the 'Slippery-Sequence' Component of a Coronavirus Ribosomal Frameshifting Signal", J. Mol. Biol., (1992), vol. 227, pp. 463-479. May 29, 1992
Brierley, I., et al., "Pseudoknot-Dependent Programmed—1 Ribosomal Frameshifting: Structures, Mechanisms and Models", Nucleic Acids and Molecular Biology, Ed. 24, Chapter 7, (2010), pp. 149-174. Jan. 1, 2010.
Brown, E., et al., "Antibody Response to Porcine Reproductive and Respiratory Syndrome Virus . . . Diagnostic Detection and Differentiation of PRRSV Types I and II", Clinical and Vaccine Immunology, (2009) vol. 16, No. 5, pp. 628-635. Feb. 24, 2009.
Chen, Z., et al., "Immunodominant Epitopes in nsp2 of Porcine Reproductive and Respiratory Syndrome Virus are Dispensable for Replication, . . . Host Immune Response", Jrnl of General Virology, (2010) vol. 91, pp. 1047-1057. Nov. 18, 2009.
Chung, B.Y.-W., et al., "Frameshifting in Alphaviruses: A Diversity of 3' Stimulatory Structures", J. Mol. Biol., (2010) vol. 397, pp. 448-456. Jan. 28, 2010.
Conzelmann, K.K., et al., "Molecular Characterization of Porcine Reproductive and Respiratory Syndrome Virus, a Member of the Arterivirus Group", Fed. Res. Centre for Virus Diseases of Animals, Fed. Repub. DE & Intervet Intl., NL, (1992) 11 pgs. Oct. 27, 1992.
de Lima, M., et al., "Development of a Porcine Reproductive and Respiratory Syndrome Virus Differentiable (DIVA) Strain Through Deletion of Specific Immunodominant Epitopes", Elsevier, Vaccine, (2008), vol. 26, pp. 3594-3600. May 19, 2008.
Demeshkina, N., et al., "A New Understanding of the Decoding Principle on the Ribosome", Nature, vol. 484, (2012), 6 pgs. Apr. 12, 2012.
Den Boon, J. A., et al., "Equine Arteritis Virus is Not a Togavirus But Belongs to the Coronaviruslike Superfamily", Jrnl of Virology, vol. 65, No. 6, (1991) pp. 2910-2920. Feb. 20, 1991.
Dinman, J.D., et al., "A—1 Ribosomal Frameshift in a Double-Stranded RNA Virus of Yeast Forms a Gag-Pol Fusion Protein", Proc. Natl. Acad. Sci. USA, vol. 88, (1991) pp. 174-178. Jan. 1, 1991.
Du, Z., et al., "Structure of a Construct of a Human Poly(C)-Binding Protein Containing the First and Second KH Domains Reveals Insights Into Its Regulatory Mechanisms", The Jrnl. of Biol. Chem., vol. 283, No. 42 (2008) pp. 28757-28766. Oct. 17, 2008.
Fang, Y., et al., "Heterogeneity in Nsp2 of European-Like Porcine Reproductive and Respiratory Syndrome Viruses Isolated in the United States", Virus Research, vol. 100, (2004), pp. 229-235, Jan. 1, 2004.
Fang, Y., et al., "Development of Genetic Markers in the Non-Structural Protein 2 Region of a US Type 1 Porcine . . . Marker Vaccine Development", Jrnl of Gen. Virology, vol. 89 (2008), pp. 3086-3096. Aug. 19, 2008.
Fang, Y., et al., "A Full-Length cDNA Infectious Cline of North American Type 1 Porcine Reproductive and Respiratory Syndrome Virus . . . Protein in the Nsp2 Region", Jrnl. of Virology, vol. 80, No. 23, (2006) pp. 11447-11455. Sep. 4, 2006.
Farabaugh, P.J., "Programmed Frameshifting in Budding Yeast", Recoding: Expansion of Decoding Rules Enriches Gene Expression, Nucleic Acid and Molecular Biology, Ed. 24, Ch. 10, (2010) 27 pgs. Jan. 1, 2010.
Firth, A. E., et al., "Evidence for Ribosomal Frameshifting and a Novel Overlapping Gene in the Genomes of Insect-Specific Flaviviruses", Jrnl. Virology, vol. 399, No. 1, (2010) pp. 153-166. Mar. 30, 2010.
Firth, A. E., et al., "Stimulation of Stop Codon Readthrough: Frequent Presence of an Extended 3' RNA Structural Element", Nucleic Acids Research, vol. 39, No. 15, (2011) pp. 6679-6691. Apr. 27, 2011.
Firth, A. E., et al., "Non-Canonical Translation in RNA Viruses", Jrnl. of General Virology, vol. 93, (2012) pp. 1385-1409. Jan. 1, 2012.
Fuerst, T. R., et al., "Eukaryotic Transient-Expression System Based on Recombinant Vaccinia Virus That Synthesizes Bacteriophage T7 RNA Polymerase", Proc. Natl. Acad. Sci. USA, vol. 83, (Nov. 1986), pp. 8122-8126. Nov. 1, 1986.
Goodman, R. P., et al., "Clinical Isolates of Trichomonas Vaginalis Concurrently Infected by Strains of Up to Four Trichomonasvirus Species (Family Totiviridae)", Jrnl. of Virology, vol. 85, No. 9, (2011) pp. 4258-4270.
Gorbalenya, A. E., et al., "Nidovirales: Evolving the Largest RNA Virus Genome", Virus Research, vol. 117, (2006) pp. 17-37. Feb. 28, 2006.
Grebennikova, T. V., et al., "Genomic Characterization of Virulent, Attentuated, and Revertant Passages of a North American Porcine Reproductive and Respiratory Syndrome Virus Strain", Virology, vol. 321, (2004) pp. 383-390. Jan. 4, 2004.
Guarraia, C., et al., "Saturation Mutagenesis of a + 1 Programmed Frameshift-Inducing mRNA Sequence Derived From a Yeast Retrotransposon", RNA, vol. 13, (2007) pp. 1940-1947. Jan. 1, 2007.
Han, J., et al., "Proteolytic Products of the Porcine Reproductive and Respiratory Syndrome Virus nsp2 Replicase Protein", Jrnl. of Virology, vol. 84, No. 19, (Oct. 2010) pp. 10102-10112. Jul. 16, 2010.
Hopp, T. P., et al., "A Computer Program for Predicting Protein Antigenic Determinants", Molecular Immunology, vol. 20, No, 4, (1983) pp. 483-489. Jan. 1, 1983.
European Patent Office, "International Search Report and Written Opinion", issued in connection to International Application No. PCT/US2013/051041, mailed Apr. 9, 2014, 18 pgs. Apr. 9, 2014.
PCT/IB/WIPO, "International Preliminary Report on Patentability", issued in connection to International Application No. PCT/US2013/051041, mailed Jan. 29, 2015, 12 pages. Jan. 29, 2015.
European Patent Office, "Invitation to Pay Additional Fees and, Where Applicable, Protest Fees", issued in connection to International Application No. PCT/US2013/051041, mailed Dec. 18, 2013, 8 pages. Dec. 18, 2013.
Ivanov, I. P., et al., "Ribosomal Frameshifting in Decoding Antizyme mRNAs From Yeast and Protists to Humans: Close to 300 Cases Reveal Remarkable Diversity Despite Underlying Conservation", Nucleic Acids Research, vol. 35, No. 6, (2007) pp. 1842-1858. Mar. 1, 2007.
Han, J., et al., "Identification of Nonessential Regions of the nsp2 Replicase Protein of Porcine Reporductive and Respiratory Syndrome Virus Strain VR-2332 for Replication in Cell Culture", Jnl. of Virology, vol. 81, No. 18, (2007), pp. 9878-9890. May 23, 2007.
Jackson, R.J., et al., "The Mechanism of Eukaryotic Translation Initiation and Principles of Its Regulation", Nat. Rev. Mol. Cell Biol., (2010) vol. 11, No. 2, pp. 113-117. Feb. 28, 2010.
Jacks, T., et al., "Two Efficient Ribosomal Frameshifting Events are Required for Synthesis of Mouse Mammary Tumor Virus Gag-Related Polyproteins", Proc. Natl. Acad. Sci. USA, (1987) vol. 84, pp. 4298-4302. Jun. 30, 1987.
Johnson, C.R., et al., "Cross-Reactive Antibody Responses to nspl and nsp2 of Porcine Reproductive and Respiratory Syndrome Virus", Jrnl. of Gen. Virology, (2007), vol. 88, pp. 1184-1195. Jan. 31, 2007.
Kim, Dal-Young, et al., "Insertion and Deletion in a Non-Essential Region of the Nonstructural Protein 2 (nsp2) of . . . (PRRS) Virus: Effects on Virulence and Immunogenicity", Virus Genes, (2009), vol. 28, pp. 118-128. Jan. 31, 2009.
Kollmus, H., et al., "Regulated Ribosomal Frameshifting by an RNA-Protein Interaction", RNA Society, (1996), vol. 2, pp. 316-323. Jan. 31, 1996.
Larkin, M.A., et al., "Clustal W and Clustal X Version 2.0" (Sequence Analysis), Bioinformatics, (2007), vol. 23, No. 21, pp. 2947-2948. Sep. 10, 2007.
Larsen, J.E.P., et al., "Improved Method for Predicting Linear B-Cell Epitopes", Immunome Research, (2006), vol. 2, No. 2, 7 pgs. Apr. 24, 2006.

(56) References Cited

OTHER PUBLICATIONS

Lauck, M., et al., "Novel, Divergent Simian Hemorrhagic Fever Viruses in a Wild Ugandan Red Colobus Monkey Discovered Using Direct Pyrosequencing", (2011), vol. 6, No. 4, 6 pgs. Apr. 22, 2011.
Li, Y., et al., "Identification of Porcine Reproductive and Respiratory Syndrome Virus ORF1a-Encoded Non-Structural Proteins in Virus-Infected Cells", Jrnl. of Gen. Virology, (2012), vol. 93, pp. 829-839 Jan. 11, 2012.
Liu, H.-W., et al., "Characteriztion of Trichomonas Vaginalis Virus Proteins in the Pathogenic Protozoan T. vaginalis", Arch. Virol., (1998), vol. 143, pp. 963-970. Jan. 31, 1998.
Loughran, G., et al., "Ribosomal Frameshifting Into an Overlapping Gene in the 2B-Encoding Region of the Cardiovirus Genome", PNAS, (2011), vol. 108, No. 46, 9 pgs. Nov. 15, 2011.
Lu, J., et al., "A 5'-Proximal Stem-Loop Structure of 5' Untranslated Region of Porcine Reproductive and Respiratory Syndrome Virus Genome is Key for Virus Replication", Virology Jrnl., (2011), vol. 8, No. 172, 15 Pgs. Jan. 30, 2011.
Maters, Paul S., "The Molecular Biology of Coronaviruses", Advances in Virus Research, vol. 66, (2006), pp. 193-292. Dec. 31, 2006.
Matsufuji, S., et al., "Reading Two Bases Twice: Mammalian Antizyme Frameshifting in Yeast", The EMBO Jrnl., (1996), vol. 15, No. 6, pp. 1360-1370. Mar. 15, 1996.
Meiring, H.D., et al., "Nanoscale LC-MS(n): Technical Design and Applications to Peptide and Protein Analysis", J. SEP. SCI., (2002), vol. 25, pp. 557-568. Mar. 12, 2002.
Melian, E. B., et al., "NS1' of Flaviviruses in the Japanese Encephalitis Virus Serogroup is a Product of Ribosomal Frameshifting and Plays a Role in Viral Neuroinvasiveness", Jrnl. of Virology, (2010), vol. 84, No. 3, pp. 1641-1647. Feb. 28, 2010.
Muelenberg, J.J.M., et al., "Lelystad Virus, The Causative Agent of Porcine Epidemic Abortion and Respiratory Syndrome (PEARS), Is Related to LDV and EAV", Virology, (1993), vol. 192, pp. 62-72. Jan. 31, 1993.
Miller, W.A., et al., "Ribosomal Frameshifting in Decoding Plant Viral RNAs", Recoding: Expansion of Decoding Rules Enriches Gene Expression, Nucleic Acids and Molecular Biology, (2010) vol. 24, 28 Pgs. Jan. 31, 2010.
Moore, R., et al., "Complete Nucleotide Sequence of a Milk-Transmitted Mouse Mammary Tumor: Two Frameshift Suppression Events Are Required for Translation of gag and pol", Jrnl. of Virology, (1987), vol. 61, No. 2, pp. 480-490. Jan. 28, 1987.
De Groot, R.J., et al. (2012), Chapter Entitled "Order Nidovirales", pp. 785-795, In A. King. et al., (Editors). Virus Taxonomy, The 9th Report of the International Committee on Taxonomy of Viruses, Academic Press. Jan. 31, 2012.
Ogle, J.M., et al., "Recognition of Cognate Transfer RNA by the 30S Ribosomal Subunit", Science, (2001) vol. 292, pp. 897-902. May 4, 2001.
Oleksiewicz, M.B., et al., "Epitope Mapping Porcine Reproduction and Respiratory Syndrome Virus by Phage Display: The nsp2 Fragment of the Replicase Polyprotein Contains a Cluster of B-Cell Epitopes", Jrnl of Virology , (2001), vol. 75, No. 7, pp. 3277-3290. Apr. 30, 2001.
Perlman, S., et al., "Coronaviruses Post-SARS: Update on Replication and Pathogenesis", Nat. Rev. Microbiol., (2009), vol. 7, No. 6, pp. 439-450. Jun. 30, 2009.
Rice, P., et al., "EMBOSS: The European Molecular Biology Open Software Suite", TIG, (2000), vol. 16, No. 6, pp. 276-277. Jun. 30, 2000.
Snijder, E.J,, et al., "Proteolytic Processing of the Replicase ORF1a Protein of Equine Arteritis Virus", Jrnl. of Virology, (Sep. 1994), vol. 68, No. 9, pp. 5755-5764. Sep. 30, 1994.
Snijder, E.J., et al., "The Arterivirus Nsp2 Protease: An Unusual Cysteine Protease With Primary Structure Similarities to Both Papain-Like and Chymotrypsin-Like Proteases", The Jrnl. of Biol. Chem., (1995), vol. 270, No. 28, pp. 16671-16676. Jul. 14, 1995.
Snijder, E.J., et al., "The Molecular Biology of Arteriviruses", Jrnl. of Gen. Virology, (1998), vol. 79, pp. 961-979. Jan. 31, 1998.
Su, H.-M., et al., "Genomic Organization and Sequence Conservation in Type I Trichomonas Vaginalis Viruses", Virology, (1996), vol. 222, No. 0446, pp. 470-473. Jun. 21, 1996.
Van Den Born, E., et al., "Secondary Structure and Function of the 5'-Proximal Region of the Equine Arteritis Virus RNA Genome", RNA, (2004), vol. 10, pp. 424-437. Jan. 31, 2004.
Xu, J., et al., "Conserved Translational Frameshift in dsDNA Bacteriophage Tail Assembly Genes", Molecular Cell, (2004), vol. 16, pp. 11-21. Oct. 8, 2004.
Xu, Z., et al., "Synthesis of a Novel Hepatitis C Virus Protein by Ribosomal Frameshift", The EMBO Jrnl., (2001), vol. 20, No. 14, pp. 3840-3848. Jan. 31, 2001.
Ying, F., et. al., "The PRRSV Replicase: Exploring the Multifunctionality of an Intriguing Set of Nonstructural Proteins", Virus Research, (2010), vol. 154, pp. 61-76. Aug. 7, 2010.
Li, Y., et al., "Genetic Analysis of Two Porcine Reproductive and Respiratory Syndrome Viruses With Different Virulence Isolated in China", Arch. Virol., (2008), vol. 153, pp. 1877-1884. Sep. 22, 2008.
Ziebuhr, J., et al., "Virus-Encoded Proteinasas and Proteolytic Processing in the Nidovirales", Jrnl of Gen. Virology, (2000), vol. 81, pp. 853-879. Jan. 31, 2000.
Fang, Ying, et al., "Efficient-2 frameshifting by mannalian ribosomes to synthesize an additional arterivirus protein", PNAS, pp. E2920-E2928.
Han, Jun, et al., "Proteolytic Products of the Porcine Reproductive and Respiratory Syndrome Virus nsp2 Replicase Protein", Journal of Virology, (2010), vol. 84, No. 19, pp. 10102-10112.
Sequence Listing, UNIPROT: A0MD28, XP2758929,Jul. 6, 2015, 8 pages.

* cited by examiner

```
                  nt                                                                                     TF ORF
LDV             2989-CAC CAG GUU UUU CUC UUG UCC UCC CAU CUC CUC GCC AUG UGG UCU GUC      169
PRRSV-NA        3877-CGU CAG GUU UUU GAC CUC GUC UCC CAU CUC CCU GUU UUC UUC UCA CGC      169
  - SD23983     3877-CGA CAG GUU UUU AAC CUC GUC UCC CAU CUC CCU GUU UUC UUC UCA CGC      169
  - SD95-21     3878-CGU CAG GUU UUU GAC CUC GUC UCC CAU CUC CCU GUU UUC UUC UCA CGC      169
PRRSV-EU        3507-ACA UGG GUU UUU GAA GUU UAC UCC CAU CUC CCA GCU UUU AUA CUC ACA      169
SHFV            2865-CAG CGG GUU UUU GGC UUG UAC CCC CAG CUC CUU UCC AUG CUG CUC CCA      225
  - krc1        2759-AGG CAG GUC UCU CAC CUC CGG CCC CAC CUC CUC CAC UUC UUA CAU GGC      219
  - krc2        2711-GAC CAG GUC UCU CGC UUC CAA CCC CAU CUC CUG GCU UUU CUC UGC UCA      220
                           *  **  * *      *       ** **  *** *        *                (codons)
```

FIG. 2A

```
   PRRSV-EU/Type 1/DQ489311/SD01-08:

WT          3507-ACA UGG GUU UUU   GAA GUU UAC UCC CAU CUC CCA GCU UUU AUA CUC ACA
IFC         3507-ACA UGG GUG UUCUU GAA GUU UAC UCC CAU CUC CCA GCU UUU AUA CUC ACA
SS          3507-ACA UGG GUA UUC   GAA GUU UAC UCC CAU CUC CCA GCU UUU AUA CUC ACA
CC1         3507-ACA UGG GUU UUU   GAA GUU UAU AGU CAU UUG CCA GCU UUU AUA CUC ACA
CC2         3507-ACA UGG GUU UUU   GAA GUU UAC AGA AAU AUG GCA GCU UUU AUA CUC ACA
KO2         3507-ACA UGG GUA UUC   GAA GUU UAU AGU CAU UUG CCA GCU UUU AUA CUG ACA

WT      3813-UUG GCU CUU GAG
KO1     3813-UUA GCU CUA GAG  (TF codons 100 and 102 → stops)

KO3:    K130A/R134A in nsp1β
```

FIG. 2B

PRRSV-NA/Type 2/KC469618/SD95-21:

WT 3878-CGU CAG GUU UUU GAC CUC GUC UCC CAU CUC CCU GUU UUC UUC UCA CGC
IFC 3878-CGU CAG GUG UUCUU GAC CUC GUC UCC CAU CUC CCU GUU UUC UUC UCA CGC
M1 3878-CGU CAG GUU UUU GGC CUC GUC UCC CAU CUC CCU GUU UUC UUC UCA CGC
CC 3878-CGU CAG GUU UUU GAC CUA GUG AGU CAU UUG CCU GUU UUC UUC UCA CGC
KO2 3878-CGU CAG GUA UUC GAC CUA GUG AGU CAU UUG CCU GUU UUC UUC UCA CGC

WT 4067-GUU CGA AUG -15nt- UGG UUG GCU UUU GCU GUU GGU
KO1 4067-GUG AGA AUG -15nt- UGG UUA GCU UUU GCU GUA GGU (TF codons 61, 70 and 74 → stops)

KO3: K124A/R128A in nsp1β

FIG. 2C

New highly divergent SHFV sequences:

```
HQ845737    2759-AGG CAG GUC UCU CAC CUC CGG CCC CAC CUC CUC CAC UUC UUA CAU GGC
HQ845738    2711-GAC CAG GUC UCU CGC UUC CAA CCC CAU CUC CUG GCU UUU CUC UGC UCA
NC_003092   2865-CAG CGG GUU UUU GGC UUG UAC CCC CAG CUC CUU UCC AUG CUG CUC CCA
JX473849    2677-GGG CGG GUU UUU GGA UUG CUA CCC CAC AUC CUU GCC UUC UUU CAU UGC
JX473848    2677-GGG CGG GUU UUU GGA UUG CUA CCC CAC AUC CUU GCC UUC UUU CAU UGC
JX473850    2684-AGG GGU GUU UUU GGA UUG CUA CCC CAC AUC CUU GCC UUC UUU CAU UGU
JX473847    2684-AGA GGU GUU UUU GGA UUG CUA CCC CAC AUC CUU GCC UUC UUU CAU UGU
                                      *       *** **   ** **        *   *
```

FIG. 2D

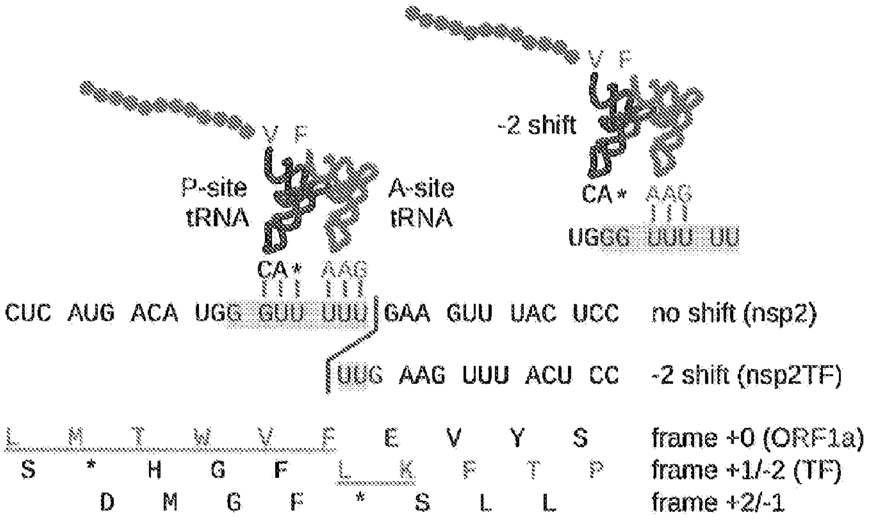

*FIG. 5A*

AAGKRARAKR ATKSGKDSAL APKIAPPVPT CGITTYSPPT DGSCGWHVLA
AIVNRMINGD FTSPLPQYNR PEDDWASDYD LAQAIQCLQL PATVVRNRAC
PNAKYLIKLN GVHWEVEVRS GMAPRSLSRE CVVGVCSEGC VAPPYPADGL
PKRALEALAS AYRLPSDCVS SGIADFLADP PPQEFWTLDK MLTSPSPERS
GFSSLYKLLL EVVPQKCGAT EGAFVYAVER MLKDCPSPEQ AMALLAKIKV
PSSKAPSVSL DECFPAGVPA DFEPAFQERP QSPGAAVALC SPDAKGFEGT
ASEEAQESGH KAVHAVPLAE GPNNEQVQVV AGEQLELGGC GLAIGSAQSS
SDSKRENMHN SREDEPLDLS HPAPAATTTL VGEQTPDNPG SDASALPIAV
RGFVPTGPIL RHVEHCGTES GDSSSPLDLS FAQTLDQPLD LSLAAWPVKA
TASDPGWVRG RCEPVFLKPR KAFSDGDSAL QFGELSESSS VIEFDQTKDT
LVADAPVDLT TSNEALSAVD PSEFVELRRP RHSAQALIDR GGPLADVHAK
IKNRVYEQCL QACEPGSRAT PATREWLDKM WDRVDMKTWR CTSQFQAGRI
LASLKFLPDM IQDTPPPVPK KNRASDSAGL KQLVARWDKK LSVTPPPKSA
GLVLDQTVPP PTDIQQEDAT PSDGLSHASD FSSRVSTSWS WKGLMLSGTR
LAGSAGQRLM TWVFLKFTPI SQLLYSHFSR RGALWLQAIG CLQVLFYLLS
CSVVLTQYSD AFPYWVSSLV LCGVFVWVFL VLGWLLLYFY SRLNPTQSVL
LVTTIRRNVM LSFWLLSSAN FGNLCAALWL APQVSYVSSL ASYSVGHVIS
GMLSYVYACL QIWPFLLFMW CPKGVVTSVG ESV

*FIG. 5B*

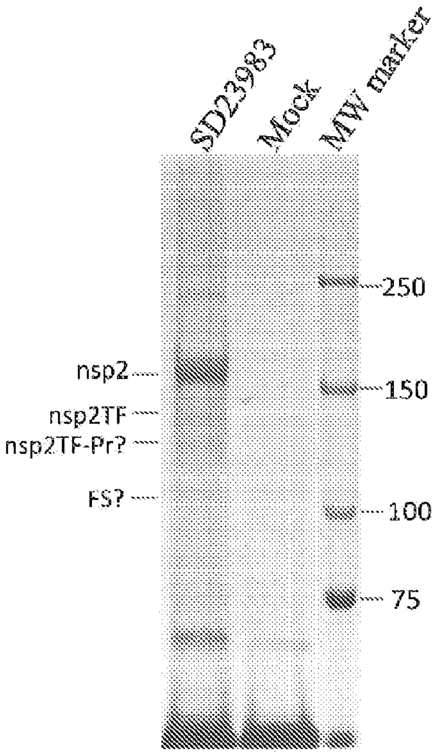

*FIG. 6A*

1 AGRRARKARH SAITAVAGRA SSAREIQQAK KHEAADANKV EHLKRYSPPA
51 EGNCGWHCIS AIANRMVNSK FETTLPERVR PPDDWATDED LVNAIQILRL
101 PAALDRNGAC ASAKYVLKLE GEHWTVTVTP GMSPSLLPLE CVQGCCEHKG
151 GLGTPDAVEV FGFDPACLNW LAEVMHLPSS AIPAALAEMS GDSGRSASPV
201 TTVWTVSQFF ARHNGGSHPD QVRLGKIISL CQVIEDCCCS QNKTNRVTPE
251 EVAAKIDLYL RGATSLEECL ARLEKARPPR VMDTSFDWDV VLPGVEAATQ
301 TTELPQVNQC RALVPVVTQK SLDNNSVPLT AFSLANYYYR AQGDEVRHRE
351 RLTAVLSKLE GVVREEYGLM PTGPGPRPTL PRGLDELKDQ MEEDLLKLAN
401 AQTTSEMMAW AVEQVDLKTW VKNYPRWTPP PPPPKVQPRK TKSAKSLLER
451 KPVPAPRRKV GTNCGSPISL GDNIPNSWED LAVGSPYDPP TPPEPATPSG
501 ELVVVSTPQC IFRPATPSSE PALIPASRGA VSRPVTPLSE PIPVPAPRRK
551 FQQVKRLSSA AVTPPYQDEP LNLSASSQTE FEAPSLAPPQ SEGVLGVKGQ
601 EAEEALSEIS DMSGDIKPAS VSSSSSLSSV RVTRPKYSAQ AIIDLGGPCS
651 GHLQEVKEAC LSIMREACDA TKLDDPATQE WLSRMWDRVD MLTWRNTSAY
701 QAFRTLDGRL KFLPKMILET PPPYPCEFVM MPHSPAPSVG AESDLTIGSV
751 ATEDVPRILE KIENVGEMTN QGPLAFSEDK PVDDQLAKDP RISSQSPDES
801 TSAPPTGTGG AGSFTDLPPS DGADADGGGP FRTIKRKAER LFDRLSRQVF
851 LTSSPISLFS SHAFSTRAVV ILRVIGVLQL LLYCASFYAT VIQHLVLLPS
901 WVCFLGLLGA SEWGFLAAGW LLLLVCSSLC PTQSALLVSL IRQSVETSFI
951 LLSFSNLGTL FAALIWAPSV SVLPFLAGYW AGHVASGTFC LGLALLQTVS
1001 WLELMCFLKA GVKSAGDLV

*FIG. 6B* nsp1β is essential for ~2 PRF in PRRSV

```
TCTGACGTTTACAGGTGGAAGAAATTTGTGATTTTTACGGACTCCTCTCCCAACGGTCGATTTCGCATGATGTGGACGCCGGAATCCGAT
TCGGATGTGTATAGATGGAAAAAGTTCGTCATCTTCACCGATAGCAGCCCTAATGGCAGATTCAGAATGATGTGGACCCCCGAGAGCGAC
 S  D  V  Y  R  W  K  K  F  V  I  F  T  D  S  S  P  N  G  R  F  R  M  M  W  T  P  E  S  D
GACTCAGCCGCCCTGGAGGTGCTGCCGCCCGAGTTAGAACGTCAGGTCGAGATCCTCACTCGGAGTTTTCCCGCTCATCACCCTATCAAC
GATAGCGCUGCUCTCGAAGTCCTCCCCCCTGAACTGGAGAGACAAGTGGAAATTCTGACCAGAAGCTTCCCTGCCCACCATCCCATTAAT
 D  S  A  A  L  E  V  L  P  P  E  L  E  R  Q  V  E  I  L  T  R  S  F  P  A  H  H  P  I  N
CTAGCTGACTGGGAGCTCACTGAGTCCCCTGAGAACGGTTTTTCTTTCGGCACGTCCCATTCTTGCGGCCACATCGTCCAGAACCCCAAC
CTGGCCGATTGGGAACTGACCGAAAGCCCCGAAAATGGCTTCAGCTTTGGGACCAGCCACAGCTGTGGGCATATTGTGCAAAATCCTAAT
 L  A  D  W  E  L  T  E  S  P  E  N  G  F  S  F  G  T  S  H  S  C  G  H  I  V  Q  N  P  N
GTGTTTGACGGCAAGTGCTGGCTCACCTGCTTTTTGGGCCAATCGGCTGAAGTGTGCTACCACGAGGAACATCTAGCTAACGCCCTCGGT
GTCTTCGATGGGAAATGTTGGCTGACATGTTTCCTGGGGCAGAGCGCCGAGGTCTGTTATCATGAAGAGCACCTGGCCAATGCTCTGGGC
 V  F  D  G  K  C  W  L  T  C  F  L  G  Q  S  A  E  V  C  Y  H  E  E  H  L  A  N  A  L  G
TACCAAACCAAGTGGGGCGTGCATGGTAAGTACCTCCAACGCAGGCTTCAAGTCCGCGGCATGCGTGCTGTGGTCGATCCTGACGGCCCT
TATCAGACAAAATGGGGGGTCCACGGCAAATATCTGCAGAGAAGACTGCAGGTGAGAGGGATGAGAGCCGTCGTGGACCCCGATGGGCCC
 Y  Q  T  K  W  G  V  H  G  K  Y  L  Q  R  R  L  Q  V  R  G  M  R  A  V  V  D  P  D  G  P
ATTCACGTTGAAGCGCTGTCTTGCTCCCAGTCTTGGGTCAGGCACCTGACTCTGAATAATGATGTCACCCCAGGATTCGTTCGCCTGACA
ATCCATGTGGAGGCCCTCAGCTGTAGCCAAAGCTGGGTGAGACATCTCACCCTCAACAACGACGTGACACCCGGCTTTGTGAGACTCACC
 I  H  V  E  A  L  S  C  S  Q  S  W  V  R  H  L  T  L  N  N  D  V  T  P  G  F  V  R  L  T
TCCATCCGCATTGTGTCCAACACAGAACCCACCGCTTTCCGGATCTTTCGGTTTGGAGCACATAAGTGGTATGGC
AGCATTAGAATCGTCAGCAATACCGAGCCTACAGCCTTTAGAATTTTCAGATTCGGCGCCCACAAATGGTACGGG
 S  I  R  I  V  S  N  T  E  P  T  A  F  R  I  F  R  F  G  A  H  K  W  Y  G
```

FIG. 9A

Test of mutations introduced in GKYLQRRLQ motif using vaccinia expression system

*K130A/R134A in type I PRRSV nsp1β corresponds to K124A/R128A in type II PRRSV nsp1β*

BindN prediction of RNA-binding residues

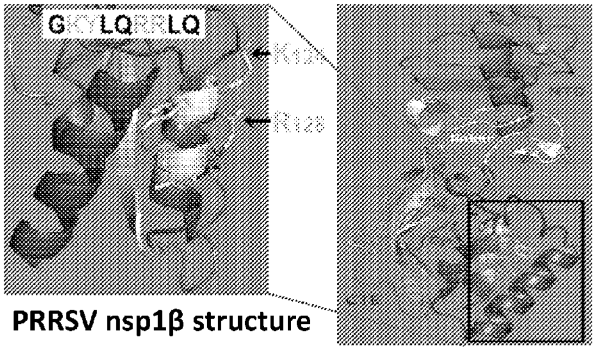

PRRSV nsp1β structure

Summary

Your sequence: 95-21
Input sequence length: 203 amino acids
Predicted binding sites: 20 residues
User-defined specificity: 90.00%
Estimated sensitivity: 37.81%

Overview

```
Sequence:      ATVYDIGHDAVMYVAERKISWAPRGGDEVKFEAVPGELRLIANRLRTSFPPHHTVDMSKF
Prediction:    -------------------++--+---------------------+--------------
Confidence:    839379969998387722767427332371867647591755315811443443856416

Sequence:      AFTAPGCGVSMRVERQHGCLPADTVPEGNCWWSLFDSLPLEVQNKEIRHANQFGYQTKHG
Prediction:    -----------+---+-------------------------------+------+--++-
Confidence:    762744324138537425354852635737565998487627232277272223621771

Sequence:      VSGKYLQRRLQVNGLRAVTDLNGFIVVQYFSVKESWIRHLKLAGEPSYSGFEDLLRIRVE
Prediction:    -+-++-++------+-------------------------------+-------+-+--
Confidence:    272873177722245676268476988658392443914936343316266566869872

Sequence:      PNTSPLADKEEKIFRFGSHKWYG
Prediction:    --------------+--------
Confidence:    22111343276165653121315
```

*** Prediction: binding residues are labeled with '+' and in red;
non-binding residues labeled with '-' and in green.
*** Confidence: from level 0 (lowest) to level 9 (highest).

FIG. 12A

BindN prediction of RNA-binding residues

Summary

Your sequence: 01-08
Input sequence length: 205 amino acids
Predicted binding sites: 14 residues
User-defined specificity: 90.00%
Estimated sensitivity: 37.81%

Overview

```
Sequence:     SDVYRWKKFVIFTDSSPNGRFRMMWTPESDDSAALEVLPPELERQVEILTRSFPAHHPIN
Prediction:   ----------------++-+-+--------------------------------------
Confidence:   225215227987551177185757345546427775976457716956821445635894

Sequence:     LADWELTESPENGFSFGTSHSCGHIVQNPNVFDGKCWLTCFLGQSAEVCYHEEHLANALG
Prediction:   ------------------------------------------------------------
Confidence:   897769344552441421221553784785755828584989734636538987883745

Sequence:     YQTKWGVHGKYLQRRLQVRGMRAVVDPDGPIHVEALSCSQSWVRHLTLNNDVTPGFVRLT
Prediction:   ---+-----++-+++---+--+-----------------------------------+--
Confidence:   111623414763688511745776977765948668262123913848247713738662

Sequence:     SIRIVSNTEPTAFRIFRFGAHKWYG
Prediction:   ----------------+--------
Confidence:   2615622343166187654632426

*** Prediction:  binding residues are labeled with '+' and in red;
                 non-binding residues labeled with '-' and in green.
*** Confidence:  from level 0 (lowest) to level 9 (highest).
```

FIG. 12B

GKYLQRRLQ motif is highly conserved in ateriviruses (PRRSV, LDV and SHFV)

nsp2TF knock out mutants reduced the deISGylation ability of PRRSV nsp2TF knock out mutants reduced the de-Ub ability of PRRSV vSD95-21
vSD95-21-K01
vSD95-21-KO2
vSD95-21-M1
vSD95-21-CC
Mock
Mock Ub Conjugates nsp1β
β-Tubulin nsp2TF knock out mutants induced protection in pigs against PRRSV challenge Up-regulation of IFN-α and IL-8 expression in nsp2TF mutants-infected pigs KO1 mutant induced earlier neutralizing antibody response

ARTERIVIRUS PROTEIN AND EXPRESSION MECHANISMS

CROSS-REFERENCE TO RELATED APPLICATIONS

This is a National Phase application claiming priority to PCT/2013/051041 filed Jul. 18, 2013 which claims priority under 35 U.S.C. §119 to provisional U.S. application Ser. No. 61/741,425 filed Jul. 18, 2012, all of which are herein incorporated by reference in their entireties.

INCORPORATION OF SEQUENCE LISTING

The instant application contains a Sequence Listing that has been submitted herewith, and is incorporated by reference in its entirety.

BACKGROUND OF THE INVENTION

Porcine reproductive and respiratory syndrome (PRRS) is the most economically significant disease of swine worldwide. It is characterized by late term reproductive failure in sows and severe pneumonia in neonatal pigs. The etiologic agent of PRRS, the PRRS virus (PRRSV), is a small, enveloped virus containing a single positive-stranded RNA genome. PRRSV is a member of the family Arteriviridae, in the order Nidovirales. The Arteriviridae family also includes equine arteritis virus (EAV), lactate dehydrogenase-elevating virus (LDV), and simian hemorrhagic fever virus (SHFV).

PRRSV can be divided into two major genotypes; Type I (also referred to as European genotype) and Type II (also referred to as North American genotype). Highly pathogenic variants (HP-PRRSV) that recently emerged in China and other Asian countries are originated from a virus of type II genotype.

The PRRSV genome is about 15 kb in length and contains at least ten open reading frames. The 3' end of the genome encodes four membrane-associated glycoproteins (GP2a, GP3, GP4 and GP5; expressed from sg mRNAs 2-5), three unglycosylated membrane proteins (E, ORF5a and M; expressed from sg mRNAs 2, 5 and 6) and a nucleocapsid protein (N; expressed from sg mRNA 7) (de Boon et al., 1991; Meulenberg et al., 1993, 1995; Snijder et al., 1999; Wu et al., 2001, 2005; Firth et al., 2011; Johnson et al., 2011).

The PRRSV replicase genes, ORF1a and ORF1b, situated in the 5'-proximal of the genome, represent nearly 75% of the viral genome. ORF1a and ORF1b encode two long replicase polyproteins, pp1a and the pp1ab, which are proteolytically processed into (at least) 14 nonstructural protein (nsp) products (Ziebuhr et al., 2000; Fang and Snijder, 2010). Of these, nsp2 is the largest cleavage product, which is released by the autoproteolytic activity of the upstream nsp1β towards the nsp1β/2 site and the cleavage of the nsp2/3 site by a papain-like protease, PLP2, residing in the N-terminal domain of nsp2 (Snijder et al., 1995).

Presently, there is no effective treatment or vaccine for combating or preventing PRRSV infection. The impact of PRRS is approximately $600 million in losses each year to the U.S. swine industry alone, and several times this amount worldwide. Basic knowledge, antiviral strategies, and tools are needed to reduce animal suffering, as well as economic losses to producers and society through the control and/or elimination of PRRS.

SUMMARY OF THE INVENTION

Applicants have discovered and characterized a conserved open reading frame (TF ORF) that overlaps the replicase ORF1a region encoding approximately the C-terminal third of nsp2 in the arteriviruses PRRSV, LDV and SHFV. Applicants have also identified a novel arterivirus protein, nsp2TF, of which the unique C-terminal domain (the TF domain) is encoded by the TF ORF. Furthermore, they have discovered that efficient −2 programmed ribosomal frameshifting (PRF) is naturally utilized as a gene expression mechanism in eukaryotic systems, and specifically that −2 PRF is utilized to express the arterivirus TF ORF.

The invention provides an arterivirus comprising nucleic acid encoding ORF1a or a functional part thereof, wherein said nucleic acid comprises at least one mutation resulting in reduced translation of nsp2TF and/or altered translation of one or more downstream products translated from said nucleic acid, in a cell infected by said arterivirus, when compared to a wild-type of said arterivirus. The arteriviruses of the invention optionally include a mutation that interferes with −2 ribosomal frameshifting at a −2 frameshifting site located in the nucleic acid sequence that encodes for the nsp2 protein. The arteriviruses of the invention optionally comprise at least one of mutation in the frameshifting site GGU(U/C)U(U/C)U and/or the conserved CCCANCUCC motif. The arteriviruses of the invention optionally comprise one or more mutations in the nucleic acid sequence that encodes for the nsp1β protein, which results in reduced −2 ribosomal frameshifting.

The invention further provides an arterivirus in which the nsp2TF function is reduced and/or absent in a cell infected by the arterivirus of the invention, when compared to a wild-type of said arterivirus. The previously mentioned arterivirus optionally comprises nucleic acid encoding ORF1a or a functional part thereof, wherein the encoded TF domain of the nsp2TF amino acid sequence is altered, truncated or absent. The arterivirus of the invention optionally comprises a modified amino acid sequence of the TF domain, wherein said amino acid is translated, and optionally provides proteins or epitopes that are absent in wild-type arterivirus but do not compromise ORF1a. Some arteriviruses provided by the invention can autonomously replicate. Any of the arteriviruses of the invention can be PRRSV, including but not limited to Type 1 (European genotype) PRRSV, Type 2 (North American genotype) PRRSV, Asian variants, or a combination thereof, or lactate dehydrogenase-elevating virus (LDV) or simian hemorrhagic fever virus (SHFV). The invention also provides an RNA or a cDNA vector encoding any of the arteriviruses provided herein.

Also provided by the invention are vaccines or immunogenic compositions, which comprise any of the arteriviruses of the invention, the cDNA described above, or a combination thereof, and optionally a pharmaceutically acceptable carrier or diluent. Also provided are vaccines or immunogenic compositions of the invention which further comprise an adjuvant, an excipient, or a combination thereof. The invention provides methods of inducing an immune response to an arterivirus in a subject, comprising administering to the subject an effective amount of a composition of the invention. The subject may be an animal, including but not limited to mammals, humans, and pigs.

The invention provides an isolated or recombinant protein, comprising a full-length or partial arterivirus TF domain protein, preferably comprising an amino acid sequence as indicated in any one of SEQ ID NO 36, 45 and 46-67, 91, and 76-91, or comprising an amino acid sequence that is at least 70% identical to any one of SEQ ID NO 36, 45 and 46-67, 91, and 76-91.

The invention provides an isolated or recombinant protein, comprising the TF domain, preferably comprising an amino acid sequence as indicated in SEQ ID NO: 61 or comprising an amino acid sequence that is at least 70% identical thereto recognizing epitopes therein, SEQ ID NO: 63, 64, and 65. Further, the invention provides an isolated or recombinant antibody that can specifically bind to the TF domain of the arterivirus nsp2TF protein or a protein of the invention.

Provided by the invention is a method of detecting the presence of an antibody to an arterivirus in a biological sample, said method comprising contacting a biological sample with an amount of TF domain protein antigen or a part thereof; detecting the presence or absence of a complex between the TF domain antigen and an antibody, using a detection system; and determining the presence or absence of a complex between the TF domain antigen and an antibody, wherein the presence of a complex indicates an immune response to an arterivirus.

Another method provided by the invention is a method for determining whether a biological sample comprises an antibody directed against arterivirus, wherein said method comprises detecting the presence of aTF-domain specific antibody in the biological sample.

The invention provides a method for distinguishing a subject infected with wild-type arterivirus and/or vaccinated with an unmodified arterivirus strain, from a subject vaccinated with a vaccine of the invention, where the method comprises providing a sample from the test subject, determining in the sample, qualitatively, quantitatively or both qualitatively and quantitatively, the presence or absence of mutations affecting −2 ribosomal frameshifting at the −2 frameshifting site located at the 5' end of the TF ORF, or modifications to the TF-domain coding region; and/or determining in the sample the presence of antibodies against an immunogenic epitope specific for the vaccine; and/or determining in the sample the presence of antibodies against an epitope expressed by said wild-type or unmodified arterivirus but not present in the vaccine.

Further provided is a method of typing an arterivirus in a biological sample, where the method comprises determining the presence and/or sequence of a −2 frameshifting site located in the nucleic acid sequence that encodes for the nsp2 protein; and/or determining the presence and/or sequence of a TF domain-coding region in the arterivirus. The invention also provides a nucleic acid comprising an arterivirus −2 frameshift site in operable linkage with nucleic acid sequence that codes for a protein, where the protein is not an arterivirus protein, and the nucleic acid preferably further comprises a ribosomal translation start codon 5' of the −2 frameshift site. The arterivirus −2 frameshift site in the nucleic acid of the invention may comprise the sequence GGU(U/C)U(U/C)U and/or a downstream CCCANCUCC sequence. Additionally, the invention provides an expression system, comprising one of the nucleic acids of the invention, where the expression system optionally further comprises nsp1β or a functional part thereof.

The invention provides a method for determining whether an agent is capable of interfering with ribosomal frameshifting at the −2 frameshifting site located at the 5'end of the TF ORF, where the method comprises providing a translation system that is permissive for frameshifting at said site with a nucleic acid encoding a genetic marker or reporter in operable linkage with said site, contacting the translation system with the agent, incubating the translation system and agent mixture to allow for translation of said nucleic acid; and determining the presence or absence of a translation product encoded by the nucleic acid. The translation product can be a complete translation product, or it can be a partial translation product. The translation system of the method of the invention provided above can comprise an arterivirus nsp1β protein or functional part thereof and/or is a cell. The agent of the method of the invention provided above can be selected from the group consisting of antisense DNA, antisense RNA, siRNA, microRNA, nucleic acid analogues, peptides, chemical compounds, or small molecules, or a combination thereof.

The invention also provides pharmaceutical compositions, which comprise an effective amount of an agent capable of interfering with −2 frameshifting in an arterivirus, and optionally a pharmaceutically acceptable carrier or diluent. The invention further provides a method of treating an animal infected by an arterivirus, comprising administering to the animal an effective amount of the pharmaceutical composition of the invention.

The invention additionally provides an expression cassette, which comprises nucleic acid encoding an arterivirus nsp2TF protein in operable linkage with a heterologous promoter. The invention provides a cell that comprises the expression cassette of the invention. A cell of the invention optionally comprises an expression cassette that is integrated into a chromosome of the cell. Any of the cells of the invention can further comprise any arterivirus as provided by the invention or a cDNA of the invention. The invention provides an arterivirus packaging cell line comprising a cell of the invention. The invention also provides an nsp2TF-expressing stable cell line comprising a cell of the invention. Further, the cells of the cell line provided by the invention express nsp2TF from a heterologous promoter.

The invention provides a kit for the diagnostic methods described herein. The invention provides an isolated nsp2TF protein, and proteins and peptides containing an immunogenic epitope of the TF domain, or any ribonucleic acid coding for such protein or peptide. The invention further provides methods for producing an immunogenic composition of the proteins and peptides described herein. The epitope is preferably between 1-500 amino acids in length, or preferably between 1-10 amino acids in length, or preferably between 10-15 amino acids in length, or preferably between 15-20 amino acids in length, or preferably between 20-25 amino acids in length, or preferably between 20-50 amino acids in length, or preferably between 50-75 amino acids in length, or preferably between 75-150 amino acids in length, or preferably between 150-250 amino acids in length, or preferably between 250-350 amino acids in length, or preferably between 350-500 amino acids in length, or larger. The epitope preferably can be between 150-275 amino acids in length, or preferably between 155-250 amino acids in length, or between 160-240 amino acids in length.

Applicants have discovered that efficient PRRSV −2 frameshifting depends on at least two RNA sequences (the actual frameshift site and a conserved downstream CCCANCUCC sequence) and the presence of nsp1β. Applicants have unexpectedly discovered that mutations that partially or completely prevent −2 frameshifiting and/or the expression of nsp2TF impair PRRSV replication and result in a smaller plaque phenotype. Provided herein are novel arteriviruses, including LDV, SHFV, and PRRS viruses, which exhibit an impaired growth phenotype with lower infectious progeny titers and reduced plaque size. Also provided herein are novel knockout mutants of arteriviruses, including LDV, SHFV, and PRRSV which allow for the effective up-regulation of nsp3-12 expression and provide an effective tool to regulate viral RNA synthesis.

The invention provides an arterivirus, comprising one or more mutations or a combination of mutations in ORF1a, wherein the level of −2 frameshifting and the expression level of the nsp2TF protein in the arterivirus is altered. The invention further provides an arterivirus, comprising a mutation or combination of mutations in ORF1a, wherein the nsp2TF protein is altered. According to an embodiment of the invention, a mutation in said arterivirus may comprise a deletion or substitution resulting in a premature stopcodon, or may comprise the insertion of one of more stop codons in the TF coding region, resulting in truncation of the nsp2TF protein. Also according to the invention, a mutation in ORF1a may occur in the coding region for the TF domain and/or frameshift site The mutation in the arterivirus of the invention can comprise a deletion and/or mutation in the nucleic acid sequence that encodes for the nsp1β protein. The invention provides an arterivirus, comprising one or more mutations in ORF1a, wherein the expression level of the nsp2TF protein in the arterivirus is reduced. The invention also provides an arterivirus, comprising one or more mutations in ORF1a resulting in the is alteration, truncation, or absence of the TF domain of nsp2TF.

The arterivirus of the invention can be any arterivirus, including but not limited to PRRSV, including but not limited to Type 1 (European genotype) PRRSV and Type 2 (North American genotype) PRRSV, Asian variants, or combinations thereof. The arterivirus of the invention can be any arterivirus, including but not limited to, lactate dehydrogenase-elevating virus (LDV) or simian hemorrhagic fever virus (SHFV). The arteriviruses of the invention can also comprise a genetic marker including but not limited to mutations that alter or delete specific sequences in the TF domain or the nsp2TF amino acid sequence.

The invention provides vaccine and/or immunogenic compositions comprising one or more of the arteriviruses of the invention, and a pharmaceutically acceptable carrier and/or diluent. The invention provides methods of inducing an immune response against an arterivirus in an animal susceptible to arterivirus infection, wherein the methods comprise the administration of an effective amount of a composition comprising one or more of the vaccine or immunogenic compositions of the invention, wherein said immune response in the animal is induced. The vaccine compositions and immunogenic compositions can be used in any animal, including but not limited to mammals, humans, and pigs.

The invention provides a pharmaceutical composition, comprising an effective amount of an inhibitory agent that inhibits the −2 frameshifting mechanism in an arterivirus, and a pharmaceutically acceptable carrier or diluent. The inhibitory agent may be selected from the group consisting of antisense DNA, antisense RNA, siRNA and microRNA, nucleic acid analogs, peptides, and small molecules, chemical compositions, or combinations thereof. Nucleic acid analogs may be selected from the group of locked nucleic acid, morphilino oligonucleotides, peptide nucleic acid, or other analogs known to those skilled in the art.

The invention provides methods of treating an animal infected by an arterivirus, comprising administering to the animal an effective amount of one or more of the pharmaceutical compositions of the invention.

The invention further provides expression systems for controlling the expression of one or more genes of interest, comprising inserting into a nucleic acid construct one or more frameshift signals from an arterivirus, and one or more nucleic acid molecules encoding one or more genes of interest. The expression systems of the invention further provides the insertion into the nucleic acid construct of one or more frameshift stimulators, wherein the frameshift signals are G_GUU_UUU, G_GUC_UCU, G_AUU_UUU, G_GUU_UUC, CCCANCUCC, or a combination thereof.

The invention provides arterivirus knock-out mutants for use in vaccines or genetic expression systems, wherein arterivirus nucleic acid encoding the TF domain of nsp2TF or a functional part thereof has been completely or partially inactivated in the viral genome.

The invention provides an in vitro method of detecting the presence of an antibody to an arterivirus in a biological sample, wherein a biological sample is contacted with an amount of the TF domain of nsp2TF or a part thereof as antigen, and using a detection system to detect the presence or absence of a complex between the TF domain antigen and an antibody, wherein a complex between the TF domain antigen and an antibody will occur only if the biological sample contains an antibody to the antigen, and wherein the presence of a complex indicates an immune response to an arterivirus.

The invention provides SEQ ID Nos. 1-26, 35-36, 45, 46-67, 68-75, and 76-97. The invention provides constructs pL1a (SEQ ID NO. 1), pLnsp2-8 (SEQ ID NO 2), pLnsp1-2 (SEQ ID NO 3), pLnsp1β-2 (SEQ ID NO 4), pLnsp1βcc-2 (SEQ ID NO 5), pLnsp2 (SEQ ID NO 6), pLnsp1-3 (SEQ ID NO 7), pLnsp1β-3 (SEQ ID NO 8), pLnsp2-3 (SEQ ID NO 9), pLnsp2-3-IFC (SEQ ID NO 10), pLnsp1β (SEQ ID NO 11), pL1a-IFC (SEQ ID NO 12), pL1a-KO1 (SEQ ID NO 13), pL1a-KO2 (SEQ ID NO 15), pL1a-SS (SEQ ID NO 17), pL1a-CC1 (SEQ ID NO 18), pL1a-CC2 (SEQ ID NO 20), pSD01-08-IFC (SEQ ID NO 22), pSD01-KO1 (SEQ ID NO 25), pSD01 KO2 (SEQ ID NO 26), pSD01-08-KO1 (SEQ ID 92) pSD01-08-KO2 (SEQ ID NO:93) pSD01-08-KO3 (SEQ ID NO:94), pSD95-21-KO1 (SEQ ID NO:95), pSD95-21-KO2 (SEQ ID NO:96), and pSD95-21-KO3 (SEQ ID NO:97), sequences that are at least 70% identical thereto, or their use in whole, in part, in or in any combination or fragment thereof, in any of the methods, expression systems and compositions of the invention, including but not limited to vaccine and immunogenic compositions.

BRIEF DESCRIPTION OF THE DRAWINGS

The following drawings form part of the specification and are included to further demonstrate certain embodiments or various aspects of the invention. In some instances, embodiments of the invention can be best understood by referring to the accompanying drawings in combination with the detailed description presented herein. The description and accompanying drawings may highlight a certain specific example, or a certain aspect of the invention. However, one skilled in the art will understand that portions of the example or aspect may be used in combination with other examples or aspects of the invention.

FIG. 2. Nucleotide sequences at and in the vicinity of the frameshift site. (A) Sequences from representative arteriviruses (Genbank accession numbers: NC_001639—LDV (SEQ ID NO. 27); NC_001961—genotype II NCBI PRRSV Ref Seq (SEQ ID NO. 28); JX258843—genotype II PRRSV isolate SD23983 (SEQ ID NO.29); DQ489311—genotype I PRRSV isolate SD01-08 (SEQ ID NO.30); NC_003092—SHFV (SEQ ID NO.31); HQ845737-8—SHFV strains krc1 (SEQ ID NO. 32) and krc2 (SEQ ID No. 33). The proposed frameshift site (confirmed in SD01-08 and SD23983) is highlighted, and nucleotide variations in SHFV isolates krc1-2 are indicated. The highly conserved downstream CCCANCUCC motif is highlighted. Spaces separate ORF1a codons. The length of the −2 frame TF ORF is indicated at right. (B) Overview of mutants used to investigate TF expression and function. Non-WT nucleotides are highlighted. WT; IFC—in-frame control; KO1—knock out 1 (premature termination codons in TF); KO2—knockout 2 (premature termination codon and disrupted frameshift cassette); SS—shift site mutant; CC1 and CC2—disrupted CCCANCUCC motif (C) Overview of mutants used to investigate TF expression and function. (D) Overview of mutants used to investigate TF expression and function.

FIG. 6. Mass spectrometric analysis of nsp2TF purified from cells infected with genotype II PRRSV strain SD23983. (A) PRRSV-infected or mock-infected MARC-145 cell lysates were immunoprecipitated with nsp2-specific mAb 140-68. Immunoprecipitated proteins were separated by SDS-PAGE and stained with Coomassie Blue. Positions of the molecular weight marker and (putative) PRRSV proteins are indicated. (B) Complete amino acid sequence of nsp2TF (SEQ ID NO 76). Peptides identified by mass spectrometry are indicated in gray (SEQ ID Nos. 77-90). The peptide spanning the frameshift site is highlighted (SEQ ID NO 91).

Figure 1:
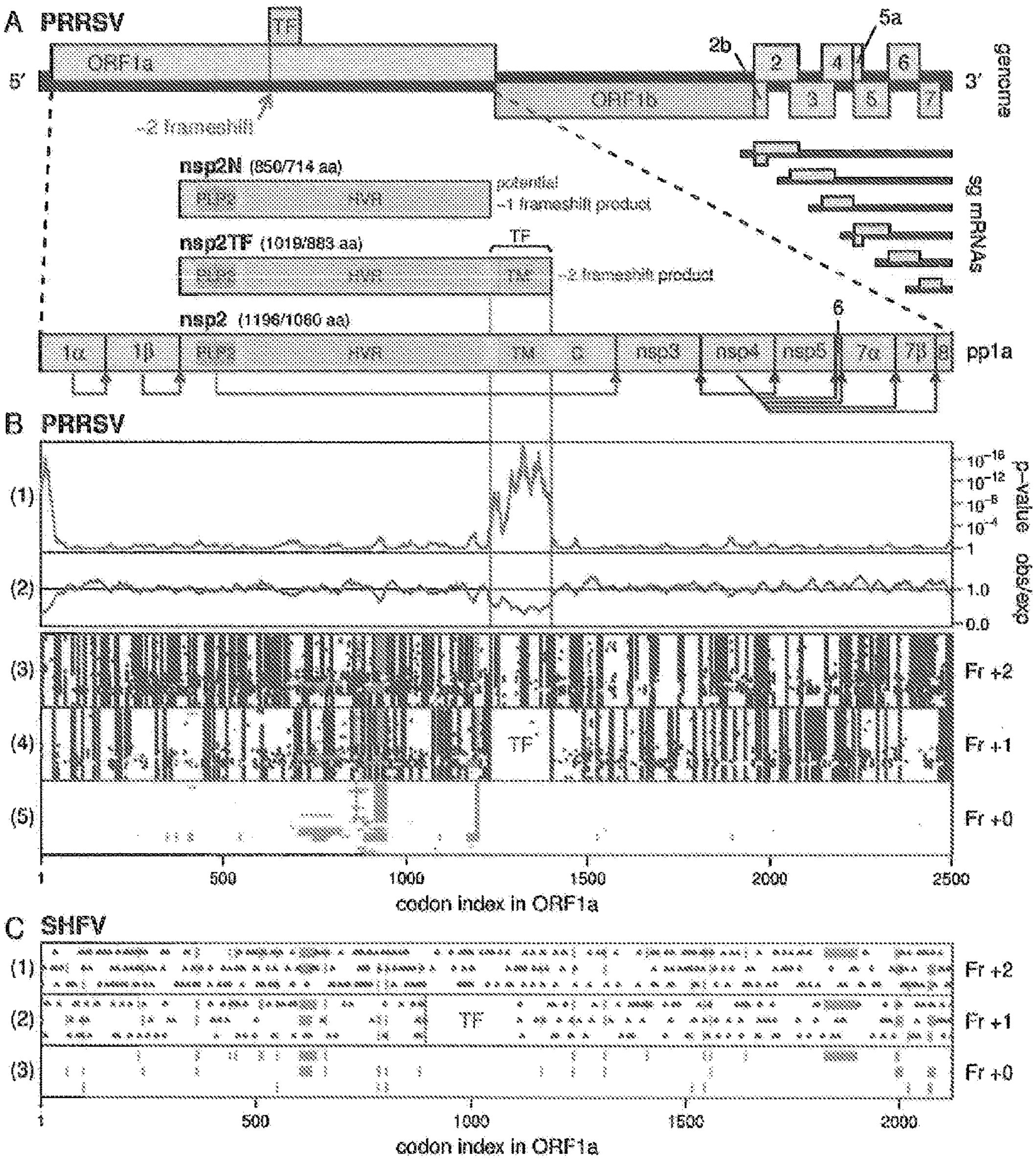
FIG. 1. Arterivirus genome organization and expression mechanisms. (A) Map of the ~15 kb PRRSV genome. Two long 5'-proximal replicase ORFs encode nonstructural polyproteins while at least eight shorter 3' ORFs encode structural proteins. The 3' ORFs are translated from a nested set of 3'-coterminal subgenomic mRNAs, two of which are bicistronic. ORF1a and ORF1b are translated from the genomic RNA, where translation of ORF1b depends on a +1 programmed ribosomal frameshift (PRF) at the end of ORF1a yielding the pp1ab replicase polyprotein. The newly described TF ORF overlaps a central region of ORF1a in the −2 reading frame, and is accessed via −2 PRF. Domains in nsp2/nsp2TF are annotated as PLP2 (papain-like protease), HVR (hypervariable region), TM/TM ((putative TM domains), and C (Cys-rich domain). Predicted sizes for nsp2-related products are shown for the NCBI RefSeq NC_001961, and the isolate SD01-08 (GenBank #DQ489311) used in this study. (B) Bioinformatic analysis of PRRSV ORF1a. Panels 1 and 2 depict the conservation at ORF1a-frame synonymous sites in an alignment of 212 PRRSV sequences using a 25-codon sliding window. Panel 2 shows the ratio of the observed number of substitutions to the number expected under a null model of neutral evolution at synonymous sites, while panel 1 shows the corresponding p-value. Summed over the whole TF ORF, the corresponding p-value is $5.7\times10^{-65}$. In order to map the conservation statistic onto the coordinates of a specific sequence in the alignment, all alignment columns with gaps in a chosen reference sequence (viz. NC_001961) were removed (note that the original alignment is gap-free within the TF ORF itself). Panels 3-5 show the positions of stop codons (triangles) in the three possible reading frames, and alignment gaps (rectangles) in all 212 aligned sequences. Note the conserved absence of stop codons in the +1 reading frame in the TF region. (C) Positions of stop codons in an alignment of three SHFV sequences. The vertical line indicates the location of the G_GU(U/C)_U(U/C)U motif. Note the conserved absence of stop codons in the +1 reading frame for 220 codons immediately following this site.

(A) Pulse-chase experiment with PRRSV-infected MARC-145 cells. Protein synthesis was labeled for 1 hr. and chased for various periods as indicated on top of the panel. Lane C0h was used to estimate the frameshifting efficiency on the basis of the amounts of nsp2, nsp2TF, and nsp2N, resulting in estimated efficiencies of 20% and 8% for −2 and −1 frameshifting, respectively. (B) Analysis of ORF1a expression in the recombinant vaccinia virus/T7 polymerase system. RK-13 cells were mock transfected or transfected with pL1a plasmid DNA. Protein synthesis was labeled for 30 min and chased up to 2 hr. (C) Analysis of nsp2TF mutants in the recombinant vaccinia virus/T7 RNA polymerase expression system. Each mutant was constructed using the pL1a backbone that expresses the full-length ORF1a polyprotein. RK-13 cells were transfected with a plasmid DNA of each construct as indicated at top of the panel. Arrows point to the C-terminus truncated nsp2TF products from mutant KO1.

FIG. 8. Analysis of N- or C-terminal ORF1a truncations using the recombinant vaccinia virus/T7 RNA polymerase expression system, revealing that nsp1β is required for efficient −2 frameshifting in PRRSV. RK-13 cells were mock-transfected or transfected with a pL-nsp construct as indicated at the top of each panel. After metabolic labeling, expression products were immunoprecipitated with a specific antibody as indicated. Abs mAb58-46 and pAbnsp2-3 recognize both nsp2 and nsp2TF, while pAb-TF recognizes nsp2TF. Immunoprecipitated proteins were separated by SDS-PAGE and visualized by autoradiography. The positions of nsp2 and nsp2TF are indicated at the left side of each panel. 99 kDa: control construct expressing a 99 kDa marker protein. pLnsp2-3-IFC: in frame control construct expressing nsp2TF only.

FIG. 9. (A) Nucleotide and amino acid sequence alignment of nsp1β coding region (top sequence: wild type nucleotide; sequence below wild type: mutated nucleotide in pLnsp1βcc-2; below nucleotides: amino acids) SEQ ID NOS 34, 35, 36. (B-C) Stimulation of ribosomal frameshift by nsp1β expression in trans. RK-13 cells were co-transfected with plasmid DNAs expressing individual nsp1β and nsp2 (B, pLnsp2/1β) or the nsp1β-2 fusion protein (C, pLnsp1β-2 and pLnsp1βcc-2). Plasmid pLnsp1βcc-2 contains a synthesized nsp1β coding sequence, with nearly every codon synonymously mutated (but avoiding rare codons). Plasmids expressing WT nsp2 (pLnsp2) and nsp2TF (pL1a-IFC) were included as controls. Cell lysates were immunoprecipitated using mAb36-19, and protein expression was analyzed by Western blotting. Membranes were probed with Abs to nsp1β, nsp2 and/or nsp2TF (referred to as "TF" in the figure) as indicated on the side of the panel. The anti-β-tubulin antibody was used to detect the expression of β-tubulin as a loading control.

FIG. 10. Surface accessibility prediction and sequence alignment of nsp1β. (A) Emini surface accessibility prediction; the peak highlighted with gray boxes showed the highest surface accessibility value. (B) Amino acid sequence alignment of nsp1β from representative type I and type II PRRSV strains. The secondary-structure elements of PRRSV nsp1β shown above the alignment are based on the crystal structure of type II PRRSV XH-GD strain (Xue et al., 2010). The highly conserved motif, GKYLQRRLQ (SEQ ID NO: 149), is highlighted in the box. Amino acid numbers at the top refer to the residue position in the nsp1β sequence of the XH-GD strain. Sequences presented in the figure were from GenBank: GU737264 (07V063), GU067771 (Amervac PRRS), GU047344 (BJEU06-1), AY366525 (EuroP-PRSV), EU076704 (HKEU16), FJ349261 (KNU-07), M96262 (LV; Lelystad Virus), GU047345 (NMEU09-1), DQ489311 (SD01-08), GQ461593 (SHE), EU624117 (XH-GD), EU708726 (JX143), AY424271 (JA142), DQ988080 (Ingelvac ATP), AF325691 (NVSL), AF494042 (P129), EF536003 (VR2332), EF488739 (MN184), AF066183.4 (RespPRRS MLV), KC469618 (SD95-21), EF112445 (JXA1), AY032626 (CH-1a), EU807840 (CH-1R), DQ779791 (Prime Pac), AF176348 (PA8), AF184212 (SP). (SEQ ID NOS:64-150).

Figure 11:
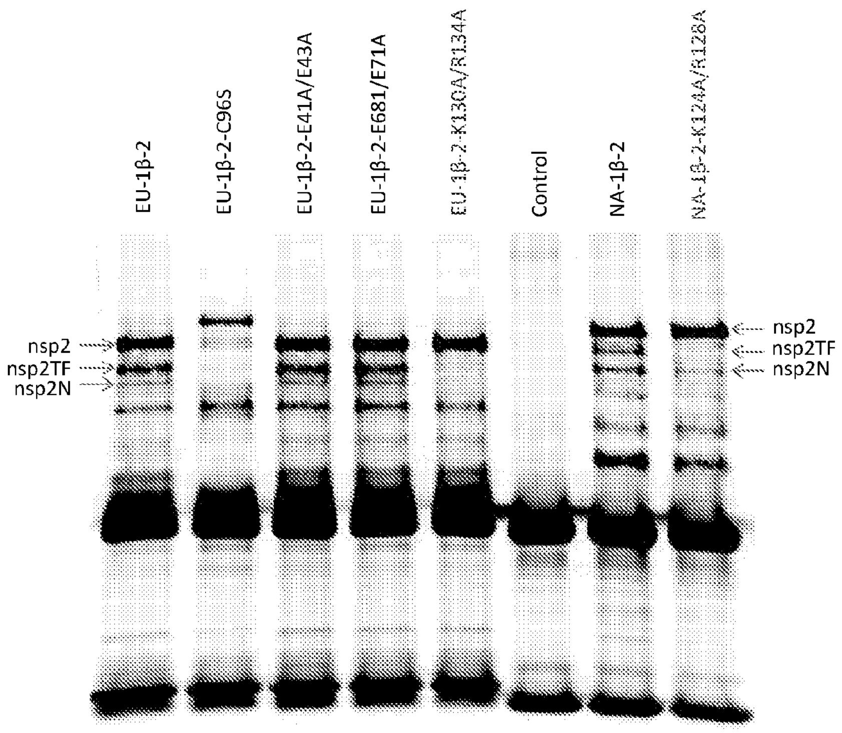

FIG. 11. Analysis of mutations in the nsp1β GKYLQRRLQ motif (SEQ ID NO: 149) using the recombinant vaccinia virus/T7 RNA polymerase expression system. HEK 293T cells (2×106) were infected with recombinant vaccinia virus and then mock-transfected or transfected with plasmid DNA expressing nsp1β-2 (or its mutant) from type I PRRSV (EU) or type 2 PRRSV (NA) at 1 hpi. After 24 hours incubation, proteins were immunoprecipitated with mAb58-46 and analyzed by SDS-PAGE. Size markers and nsp2-related products are indicated at the side of each panel.

FIG. 12. Prediction of RNA binding sites in PRRSV nsp1β. The nsp1β amino acid sequence of type 1 PRRSV SD01-08 or type 2 PRRSV SD95-21 was analyzed using BindN software worldwide web at bioinfo.ggc.org/bindn. The '+' symbol in below the text line represents a predicted RNA-binding amino acid while the '−' symbol in represents a non-binding amino acid. Numbers below the line represent confidence levels, from level 0 (lowest) to level 9 (highest). The GKYLQRRLQ motif (SEQ ID NO: 149) is highlighted with a bar above the sequences. Upper right panels shown the nsp1β crystal structure; note the GKYLQRRLQ motif exposed on the protein surface. SEQ ID NOS 151 and 152

Figure 13:
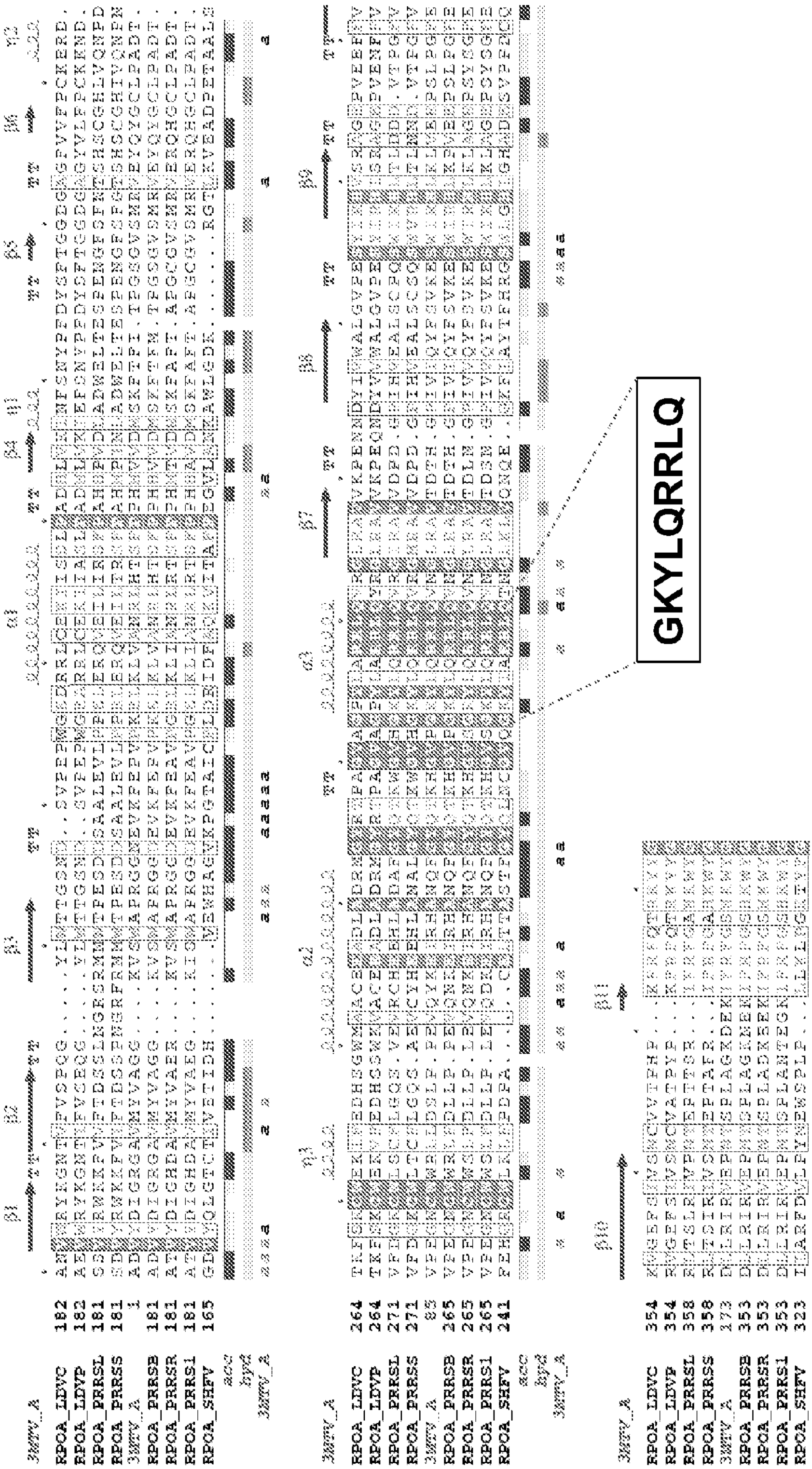
Figure 14A:
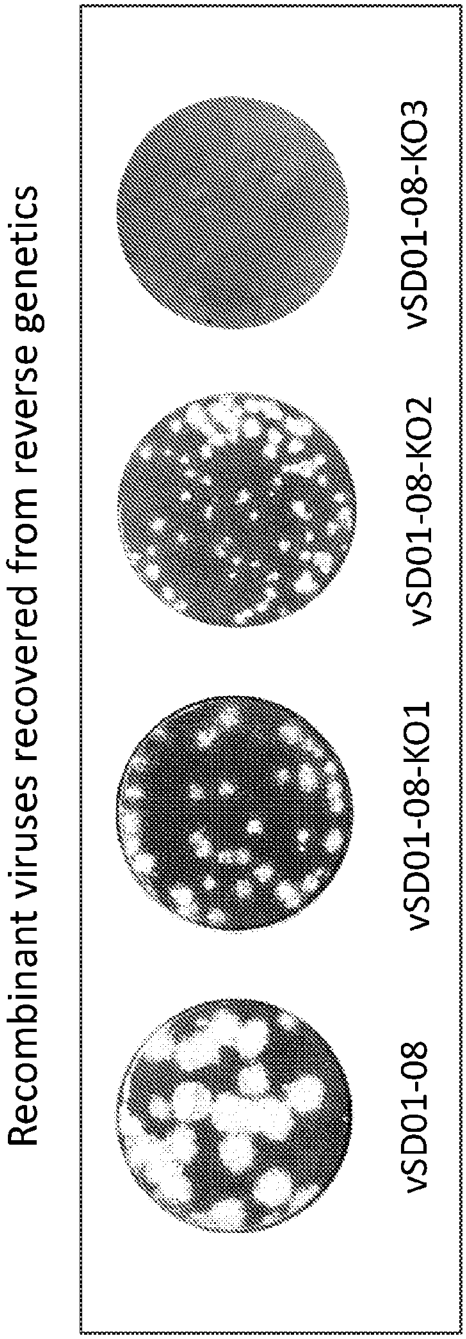
Figure 14B:
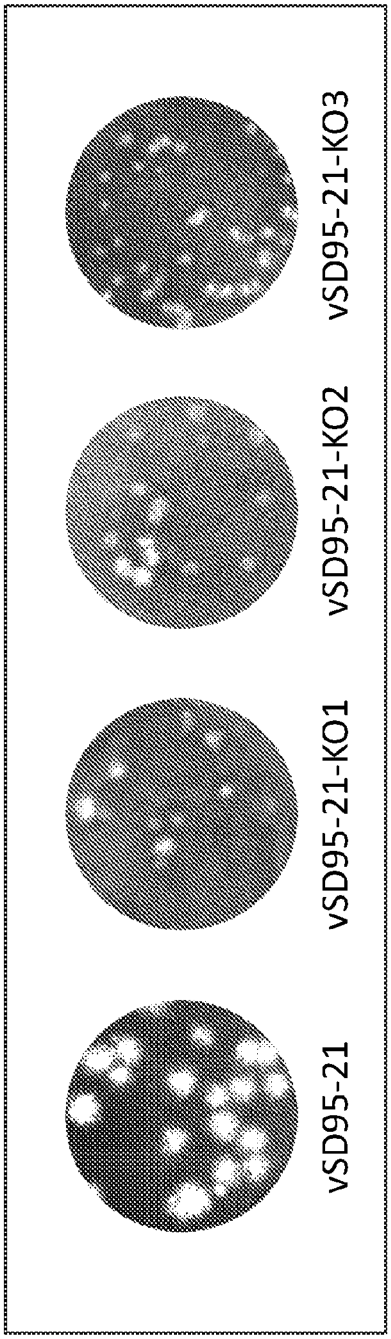
Figure 14C:
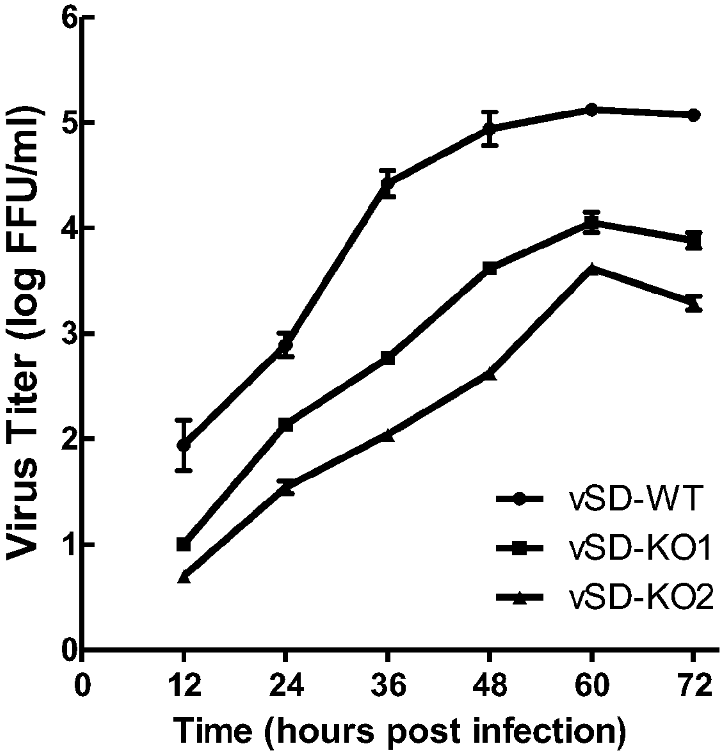
Figure 14D:
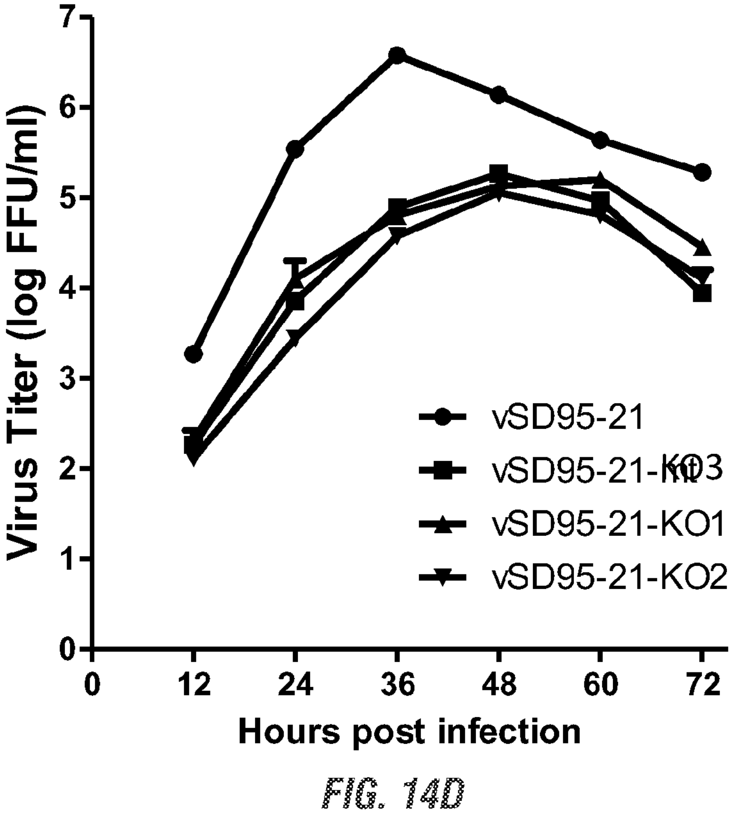

FIG. 13. Amino acid sequence alignment of nsp1β from PRRSV, LDV and SHFV. The figure was generated by the ENDscript program. The secondary-structure elements of PRRSV nsp1β shown at the top of the alignment are based on the crystal structure of type II PRRSV XH-GD strain (Xue et al., 2010). Sequences presented in the figure are from UniProt. The conserved motif, GKYLQRRLQ, (SEQ ID NO:158) is highlighted. Abbreviations: hyd—hydropathy; acc—crystallographic contacts; a—contacts between the protein and the two GLC molecules, as well as crystallographic contacts. SEQ ID NOS 148-157

FIG. 14. Comparison of growth characteristics of WT PRRSV and nsp2TF knockout mutants. (A-B). Plaque morphology of nsp2TF knockout viruses and WT virus from type 1 PRRSV (A) and type 2 PRRSV (B). Confluent MARC-145 cell monolayers were infected with 10-fold serial dilutions of the WT or recombinant virus. At 2 h post-infection, the cell culture supernatant was removed and an agar overlay was applied. Plaques were detected after 5 days (type 1 virus) or 3 days (type 2 virus) of incubation at 37° C., and stained with 0.1% crystal violet. (C-D). Growth kinetics of nsp2TF knockout viruses in comparison with that of WT virus from type 1 PRRSV (C) and type 2 PRRSV (D). MARC-145 cells were infected with each virus at an MOI of 0.1, and the amount of virus produced at 12, 24, 36, 48, 60, and 72 hpi was determined by fluorescent focus assay in MARC-145 cells. The results shown are mean values from three replicates, and virus titers were expressed as numbers of fluorescent-focus units per milliliter (FFU/ml).

FIG. 15. Effect of nsp2TF knockout mutations on the deISGylation ability of PRRSV. MARC-145 cells were infected with 0.1 MOI of wild-type PRRSV or nsp2TF knockout mutant. Mock-infected cells were included as a control. At 24 h post infection, cells were stimulated with 1,000 U/ml of IFN-α. (A) Cells were harvested at 12 h post stimulation and analyzed by immunoblotting. Free and conjugated forms of ISG15 were detected by anti-ISG15 polyclonal antiserum. MAb 123-128 was used to detect the expression of nsp1β. The anti-β-tubulin antibody was used to detect the expression of β-tubulin (loading control). (B) Following a 1 h metabolic labeling with 35S, nsp2-related products were immunoprecipitated with mAb140-68. Precipitated proteins were analyzed by SDS/PAGE and detected by autoradiography.

Figure 16:
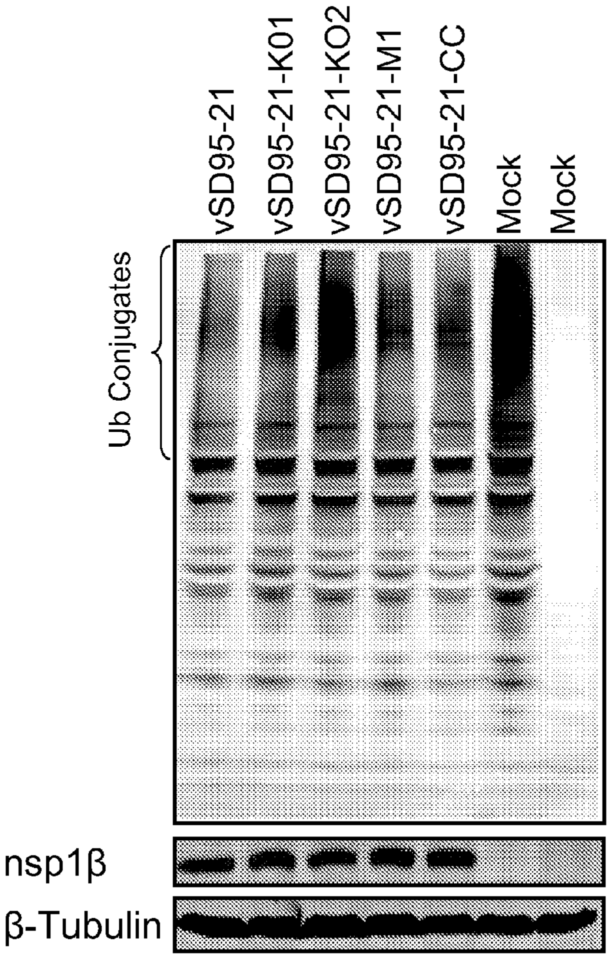

FIG. 16. Effect of nsp2TF knockout mutations on the de-ubiquitination ability of PRRSV. HEK-293T cells were cotransfected with a plasmid expressing HA-tagged ubiquitin and a full length cDNA clone of wild-type PRRSV or nsp2TF knockout mutants. Cells were lysed at 36 h post-transfection and analyzed by Western blotting using anti-HA mAb. MAb 123-128 was used to detect the expression of nsp1β. The anti-β-tubulin antibody was used to detect the expression of β-tubulin (loading control).

FIG. 17. Comparison of viral load and gross lung pathology from non-immunized and immunized pigs that were challenged with wild type PRRSV. Pigs were challenged at 28 dpv, shown as a black vertical dotted line. (A) Log Viral load quantified by real-time RT-PCR (RNA copy number/ml). (B) Comparison of gross lung lesion scores between groups of non-vaccinated and vaccinated pigs at 13 days post challenge. Lung lesion score is assigned based on the evaluation of percent pneumonia in each lobe and then added up for entire lung. Data points were presented as mean percentage of gross lung lesion scores.

Figure 18A:
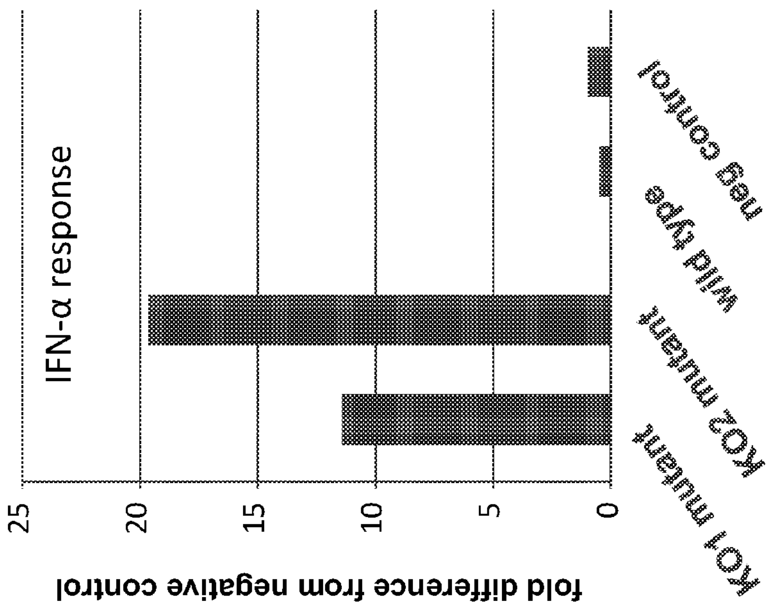
Figure 18B:
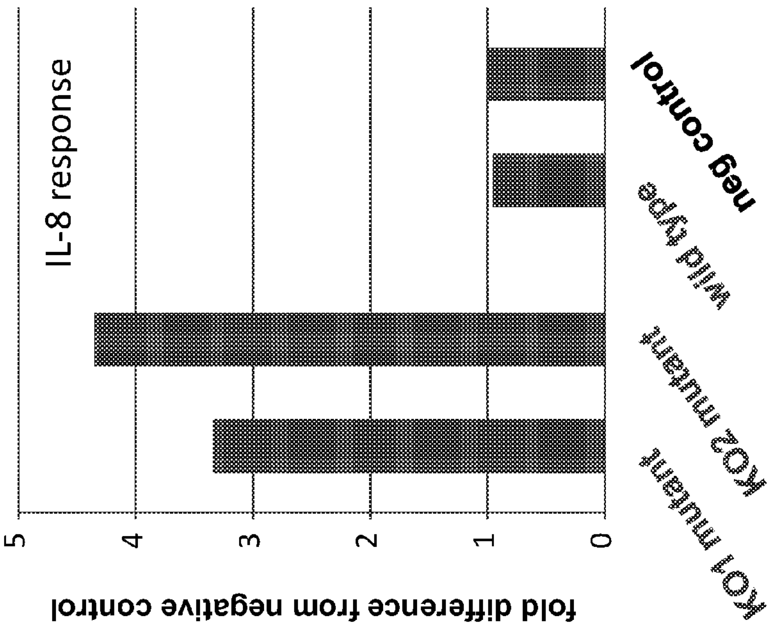

FIG. 18. Comparison of immune marker gene expression in activated PBMCs from pigs vaccinated with nsp2TF knock out mutants or wild-type virus. PBMCs were harvested at 7 dpv and stimulated in culture with the mutant virus, parental virus or medium. Cell culture supernatants were harvested at 24 h after stimulation. Cytokine protein IFN-a (A) or IL-8 (B) expression was determined by Luminex fluorescent microsphere immunoassay. Each data point was interpolated using a five-parameter logistic regression curve and displayed as fold changes of mean fluorescent unit (n=3) in comparison to negative control group of pigs.

FIG. 19. Antibody response in pigs vaccinated with nsp2TF knock out mutants or wild-type virus. (A) PRRSV-specific serum antibodies measured by IDEXX HerdChek® PRRSV ELISA 3XR kit. S/P ratios of greater than 0.4 are considered positive. (B) Serum neutralizing antibody response determined by fluorescent focus neutralization assay. Results were interpreted as a 90% reduction of the viral infection, and the neutralizing antibody titers were presented as mean value (n=5) and expressed on a log 2 scale. The wild-type virus was used for the viral neutralizing assay.

DETAILED DESCRIPTION OF THE INVENTION

Definitions

As used herein, the recited terms have the following meanings. All other terms and phrases used in this specification have their ordinary meanings as one of skill in the art would understand. Such ordinary meanings may be obtained by reference to technical dictionaries, such as Hawley's Condensed Chemical Dictionary 14th Edition, by R. J. Lewis, John Wiley & Sons, New York, N.Y., 2001.

References in the specification to "one embodiment", "an embodiment", etc., indicate that the embodiment described may include a particular aspect, feature, structure, moiety, or characteristic, but not every embodiment necessarily includes that aspect, feature, structure, moiety, or characteristic. Moreover, such phrases may, but do not necessarily, refer to the same embodiment referred to in other portions of the specification. Further, when a particular aspect, feature, structure, moiety, or characteristic is described in connection with an embodiment, it is within the knowledge of one skilled in the art to affect or connect such aspect, feature, structure, moiety, or characteristic with other embodiments, whether or not explicitly described.

The singular forms "a," "an," and "the" include plural reference unless the context clearly dictates otherwise. It is further noted that the claims may be drafted to exclude any optional element. As such, this statement is intended to serve as antecedent basis for the use of exclusive terminology, such as "solely," "only," and the like, in connection with the recitation of claim elements or use of a "negative" limitation.

The term "and/or" means any one of the items, any combination of the items, or all of the items with which this term is associated. The phrase "one or more" is readily understood by one of skill in the art, particularly when read in context of its usage. The term "about" can refer to a variation of, for example, ±5%, ±10%, ±20%, or ±25% of the value specified. For example, "about 50" percent can in some embodiments carry a variation from 45 to 55 percent. For integer ranges, the term "about" can include one or two integers greater than and/or less than a recited integer at each end of the range. Unless indicated otherwise herein, the term "about" is intended to include values, e.g., weight percents, proximate to the recited range that are equivalent in terms of the functionality of the individual ingredient, the composition, or the embodiment.

As will be understood by the skilled artisan, all numbers, including those expressing quantities of ingredients, properties such as molecular weight, reaction conditions, and so forth, are approximations and are understood as being optionally modified in all instances by the term "about." These values can vary depending upon the desired properties sought to be obtained by those skilled in the art utilizing the teachings of the descriptions herein. It is also understood that such values inherently contain variability necessarily resulting from the standard deviations found in their respective testing measurements.

As will be understood by one skilled in the art, for any and all purposes, particularly in terms of providing a written description, all ranges recited herein also encompass any and all possible sub-ranges and combinations of sub-ranges thereof, as well as the individual values making up the range, particularly integer values. A recited range includes each specific value, integer, decimal, or identity within the range. Any listed range can be easily recognized as sufficiently describing and enabling the same range being broken down into at least equal halves, thirds, quarters, fifths, or tenths. As a non-limiting example, each range discussed herein can be readily broken down into a lower third, middle third and upper third, etc.

As will also be understood by one skilled in the art, all language such as "up to", "at least", "greater than", "less than", "more than", "or more", and the like, include the number recited and such terms refer to ranges that can be subsequently broken down into sub-ranges as discussed above. In the same manner, all ratios recited herein also include all sub-ratios falling within the broader ratio.

One skilled in the art will also readily recognize that where members are grouped together in a common manner, such as in a Markush group, the invention encompasses not only the entire group listed as a whole, but each member of the group individually and all possible subgroups of the main group. Additionally, for all purposes, the invention encompasses not only the main group, but also the main group absent one or more of the group members. The invention therefore envisages the explicit exclusion of any one or more of members of a recited group. Accordingly, provisos may apply to any of the disclosed categories or embodiments whereby any one or more of the recited elements, species, or embodiments, may be excluded from such categories or embodiments, for example, as used in an explicit negative limitation.

The term "contacting" refers to the act of touching, making contact, or of bringing to immediate or close proximity, including at the cellular or molecular level, for example, to bring about a physiological reaction, a chemical reaction, or a physical change, e.g., in a solution, in a reaction mixture, in vitro, or in vivo.

An "effective amount" refers to an amount effective to treat a disease, disorder, and/or condition, or to bring about a recited effect, such as confer immunity or prevent a disease from occurring. For example, an amount effective can be an amount effective to reduce the progression or severity of the condition or symptoms being treated. Determination of a therapeutically effective amount is well within the capacity of persons skilled in the art, especially in light of the detailed disclosure provided herein. The term "effective amount" is intended to include an amount of a compound described herein, or an amount of a combination of compounds or compositions described herein, e.g., that is effective to treat or prevent a disease or disorder, or to treat the symptoms of the disease or disorder, in a host. Thus, an "effective amount" generally means an amount that provides the desired effect.

The terms "treating", "treat" and "treatment" include (i) preventing a disease, pathologic or medical condition from occurring (e.g., prophylaxis); (ii) inhibiting the disease, pathologic or medical condition or arresting its development; (iii) relieving the disease, pathologic or medical condition; and/or (iv) diminishing symptoms associated with the disease, pathologic or medical condition. Thus, the terms "treat", "treatment", and "treating" extend to prophylaxis and include prevent, prevention, preventing, lowering, stopping or reversing the progression or severity of the condition or symptoms being treated. As such, the term "treatment" includes medical, veterinary, therapeutic, and/or prophylactic administration, as appropriate.

The terms "inhibit", "inhibiting", and "inhibition" refer to the slowing, halting, or reversing the growth or progression of a disease, infection, condition, or group of cells. The inhibition can be greater than about 20%, 40%, 60%, 80%, 90%, 95%, or 99%, for example, compared to the growth or progression that occurs in the absence of the treatment or contacting.

The term "vaccine" as used herein refers to a composition that stimulates the host immunity against a pathogen. Host immune responses comprise antibodies (humoral immune response), as well as innate and cell mediated immune responses, such as production of cytokines. A vaccine therefore can protect a subject from the disease or lessen the effects of a disease in a subject. Vaccines may be administered through needle injections (including but not limited to intramuscular, intradermal, or subcutaneous injections), by mouth or by aerosol (including but not limited to intranasal delivery), or by others means known to those skilled in the art.

The vaccine can be one of any number of vaccine types, including, but not limited to live, attenuated virus (MLV) vaccines, killed vaccines, toxoid vaccines, conjugate vaccines, DNA or RNA vaccines, marker vaccines, recombinant bacterial or viral vector vaccines, and subunit vaccines, which can contain anywhere from 1 to 20 or more antigens.

An attenuated vaccine, or a modified live virus vaccine, is a vaccine in which live virus is weakened either through chemical or physical processes or through genetic modification, in order to produce an immune response without causing the severe effects of the disease. An inactivated vaccine, or killed vaccine, is a vaccine that is made from viruses or bacteria that have been killed through physical or chemical processes. These killed organisms cannot cause disease.

"Immunization," as used herein, refers to the process by which a person or animal becomes protected against a disease. This term is often used interchangeably with vaccination or inoculation.

A "combination vaccine" is a vaccine that comprises two or more vaccines administered in a single dose.

As used herein, the term "antigen" refers to a substance that is capable of eliciting or inducing or stimulating an immune response, and/or reacts specifically with B and/or T cells. Additionally, as used herein, an antigen can be a cell, bacteria, or a virus particle, or portion thereof, or an immunogenic synthetic, recombinant or naturally occurring protein or peptide, or portion thereof. An antigen can be of viral or bacterial origin, or can be a substance which is foreign material to a biological system. An antigen may be referred to as an immunogen. An antigen may also be a component of a viral coat, or a complete or partial form of a viral protein, or viral genetic material, wherein the actual virus is the causative agent of a disease.

As used herein, the word "attenuate" is defined to include, but not be limited to, inhibit, weaken, decrease, impair, reduce, and diminish.

As used herein, the word "adjuvant," is defined to include, but not be limited to, a substance (e.g. aluminum salt) that is added to a vaccine composition to increase a subject's immune response to a vaccine.

As used herein, "immunogenic" refers to the ability of a substance, including an antigen to induce an immune response.

The term "animal," as used herein, refers to any of a kingdom of living things including, but not limited to a member of Kingdom Animalia, including many-celled organisms, and the single-celled organisms that typically differ from plants in 1) having cells without cellulose walls, 2) lacking chlorophyll and the capacity for photosynthesis, 3) requiring more complex food materials, for example, proteins, 4) being organized to a greater degree of complexity, and 5) having the capacity for spontaneous movement and rapid motor responses to stimulation. The term animal, as used herein, also refers to any of Kingdom Animalia grand divisions, or subkingdoms, and the principal classes under them, including, but not limited to: Vertebrata, including Mammalia or mammals, including Ayes or birds, Reptilia, Amphibia, Pisces or fishes, Marsipobranchiata (Craniota); and Leptocardia (Acrania). Tunicata, including the Thaliacea, and Ascidioidea or ascidians. Articulata or Annulosa, including Insecta, Myriapoda, Malacapoda, Arachnida, Pycnogonida, Merostomata, Crustacea (Arthropoda); and Annelida, Gehyrea (Anarthropoda). Helminthes or vermes, including Rotifera, Chaetognatha, Nematoidea, Acanthocephala, Nemertina, Turbellaria, Trematoda, Cestoidea, Mesozea. Molluscoidea, including Brachiopoda and Bryozoa. Mollusca, including Cephalopoda, Gastropoda, Pteropoda, Scaphopoda, Lamellibranchiata or Acephala. Echinodermata, including Holothurioidea, Echinoidea, Asterioidea, Ophiuroidea, and Crinoidea. Coelenterata, including Anthozoa or polyps, Ctenophora, and Hydrozoa or Acalephs. Spongiozoa or Porifera, including the sponges. Protozoa, including Infusoria and Rhizopoda. The term animal, as used herein, further refers to the following non-limiting examples: human, primate, dog, cat, cow, lamb, pig, hog, poultry, horse, mare, mule, jack, jenny, colt, calf, yearling, bull, ox, sheep, goat, llama, bison, buffalo, lamb, kid, shoat, hen, chicken, turkey, duck, goose, ostrich, other birds or fowl, rabbit, hare, guinea pig, hamster mouse, rat, other rodents, fish and other aquatic species, and amphibians. The term "animal" as used herein additionally refers to transgenic animals.

A mammal, as used herein, includes a primate, human, rodent, canine, feline, bovine, ovine, equine, swine, caprine, bovine and the like.

The term "virus", as used herein, refers to a submicroscopic infectious agent that is unable to replicate or reproduce outside a host cell. It is non-cellular. It consists of a core of DNA or RNA surrounded by a protein coat and optionally a membrane shell.

The phrase "RNA virus", as used herein, generally refers to a virus containing RNA as its genetic material. Messenger RNA (mRNA) is a molecule of RNA that carries genetic coding information for protein synthesis. RNA viruses can be further classified according to the sense or polarity of their RNA into negative-sense RNA viruses, positive-sense RNA viruses, and double-stranded RNA viruses. Positive-sense viral RNA is similar to mRNA and thus can be immediately translated by the host cell upon viral infection. Such viruses need an RNA-dependent RNA-polymerase to replicate their RNA, but animal cells do not seem to possess a suitable enzyme. Therefore, this type of animal RNA virus needs to code for an RNA-dependent RNA polymerase.

As used herein, the term "epitope" refers to a site or a fragment of a polypeptide or protein having antigenic or immunogenic activity in an animal. An epitope having immunogenic activity is a site or fragment of a polypeptide or protein that elicits an antibody response in an animal. An epitope having antigenic activity is a site or fragment of a polypeptide or protein to which an antibody immunospecifically binds as determined by any method well-known to one of skill in the art, for example by immunoassays.

As used herein, the term "fragment" in the context of a proteinaceous agent refers to a peptide or polypeptide comprising an amino acid sequence of at least 2 contiguous amino acid residues, at least 5 contiguous amino acid residues, at least 10 contiguous amino acid residues, at least 15 contiguous amino acid residues, at least 20 contiguous amino acid residues, at least 25 contiguous amino acid residues, at least 40 contiguous amino acid residues, at least 50 contiguous amino acid residues, at least 60 contiguous amino residues, at least 70 contiguous amino acid residues, at least 80 contiguous amino acid residues, at least 90 contiguous amino acid residues, at least 100 contiguous amino acid residues, at least 125 contiguous amino acid residues, at least 150 contiguous amino acid residues, at least 175 contiguous amino acid residues, at least 200 contiguous amino acid residues, at least 250 contiguous amino acid residues, at least 300 contiguous amino acid residues, at least 300 contiguous amino acid residues, at least 500 contiguous amino acid residues, at least 750 contiguous amino acid residues, at least 1000 contiguous amino acid residues, or between 6 to 75 contiguous amino acid residues, between 25 to 150 contiguous amino acid residues, or between 25 to 300 contiguous amino acid residues of the amino acid sequence of a peptide, polypeptide or protein.

As used herein, the term "fragment" in the context of a nucleic acid refers to a nucleic acid comprising an nucleic acid sequence of at least 2 contiguous nucleotides, at least 5 contiguous nucleotides, at least 10 contiguous nucleotides, at least 15 contiguous nucleotides, at least 20 contiguous nucleotides, at least 25 contiguous nucleotides, at least 30 contiguous nucleotides, at least 35 contiguous nucleotides, at least 40 contiguous nucleotides, at least 50 contiguous nucleotides, at least 60 contiguous nucleotides, at least 70 contiguous nucleotides, at least contiguous 80 nucleotides, at least 90 contiguous nucleotides, at least 100 contiguous nucleotides, at least 125 contiguous nucleotides, at least 150 contiguous nucleotides, at least 175 contiguous nucleotides, at least 200 contiguous nucleotides, at least 250 contiguous nucleotides, at least 300 contiguous nucleotides, at least 350 contiguous nucleotides, at least 380 contiguous nucleotides, or between 8 to 75 contiguous nucleotides, between 25 to 150 contiguous nucleotides, or between 25 to 300 contiguous nucleotides of the nucleic acid sequence encoding a peptide, polypeptide or protein.

As used herein, the term "infection" means the invasion by and presence of a virus in a cell or a subject. In one embodiment, an infection is an "active" infection, i.e., one in which the virus is replicating in a cell or a subject. Such an infection is characterized by the spread of the virus to other cells, tissues, and/or organs, from the cells, tissues, and/or organs initially infected by the virus. An infection may also be a latent infection, i.e., one in which the virus is not replicating. In one embodiment, an infection refers to the pathological state resulting from the presence of the virus in a cell or a subject, or by the invasion of a cell or subject by the virus.

As used herein, the term "isolated," in the context of viruses, refers to a virus that is derived from a single parental virus. A virus can be isolated using routine methods known to one of skill in the art including, but not limited to, those based on plaque purification and limiting dilution.

As used herein, the term "isolated" in the context of a compound other than a proteinaceous agent or a nucleic acid refers to a compound that is substantially free of chemical precursors or other chemicals when chemically synthesized. The phrase "substantially free of chemical precursors or other chemicals" includes preparations of a compound that have less than about 30%, 25%, 20%, 10%, 5%, or 1% (by dry weight) of chemical precursors or other chemicals. In a specific embodiment, the compound is about 60%, preferably 65%, 70%, 75%, 80%, 85%, 90% or 99% free of other different compounds. In another specific embodiment, a compound disclosed herein is isolated. As used herein, the term "isolated" in the context of a proteinaceous agent (e.g., a protein, polypeptide or peptide) refers to a proteinaceous agent which is substantially free of cellular material or contaminating proteins from the cell or tissue source from which it is derived, or substantially free of chemical precursors or other chemicals when chemically synthesized.

The phrase "substantially free of cellular material" includes preparations of a proteinaceous agent in which the proteinaceous agent is separated from cellular components of the cells from which it is isolated or recombinantly produced. Thus, a proteinaceous agent that is substantially free of cellular material includes preparations of a proteinaceous agent having less than about 30%, 25%, 20%, 15%, 10%, or 5% (by dry weight) of a contaminating protein (e.g., a heterologous protein, polypeptide, or peptide). When the proteinaceous agent is recombinantly produced, it is also preferably substantially free of culture medium, i.e., culture medium represents less than about 20%, 15%, 10%, or 5% of the volume of the protein preparation. When the proteinaceous agent is produced by chemical synthesis, it is preferably substantially free of chemical precursors or other chemicals, i.e., it is separated from chemical precursors or other chemicals which are involved in the synthesis of the proteinaceous agent. Accordingly, such preparations of a proteinaceous agent have less than about 30%, 20%, 10%, 5% (by dry weight) of chemical precursors or compounds other than the proteinaceous agent of interest. In a specific embodiment, a proteinaceous agent disclosed herein is isolated.

As used herein, the term "small molecules" and analogous terms include, but are not limited to, peptides, peptidomimetics, amino acids, amino acid analogs, polynucleotides, polynucleotide analogs, nucleotides, nucleotide analogs, other organic and inorganic compounds (i.e., including heterorganic and organometallic compounds) having a molecular weight less than about 10,000 grams per mole, organic or inorganic compounds having a molecular weight less than about 5,000 grams per mole, organic or inorganic compounds having a molecular weight less than about 1,000 grams per mole, organic or inorganic compounds having a molecular weight less than about 500 grams per mole, organic or inorganic compounds having a molecular weight less than about 100 grams per mole, and salts, esters, and other pharmaceutically acceptable forms of such compounds. Salts, esters, and other pharmaceutically acceptable forms of such compounds are also encompassed.

As used herein, the terms "therapies" and "therapy" can refer to any protocol(s), method(s), compositions, formulations, and/or agent(s) that can be used in the prevention, treatment, management, and/or amelioration of a condition (e.g., a viral infection or a condition or symptom associated therewith, or a condition in which attenuated viruses can be used as a vector to induce an immune response to a particular antigen associated with the condition). In certain embodiments, the terms "therapies" and "therapy" refer to biological therapy, supportive therapy, and/or other therapies useful in treatment, management, prevention, and/or amelioration of a condition (e.g., viral infection or a condition or symptom associated therewith, or a condition in which an attenuated virus can be used as a vector to induce an immune response to a particular antigen associated with the condition), known to one of skill in the art. In an embodiment, a therapy is an attenuated virus or an inactivated virus mutant.

As used herein, the phrase "wild-type virus" refers to the types of a virus that are prevalent, circulating naturally and producing typical outbreaks of disease.

As used herein, the phrase "detection system" refers to art-recognized assays, protocols or methods for determining the presence of proteins. Examples of detection systems applicable to the methods of the invention include, but are not limited to, immunoassays, including fluorescent, enzyme, radio and magnetic; absorbance assays; colorimetric assays; microscopy; protein immunostaining; immunoprecipitation; immunoelectrophoresis; immunoblotting; Western blotting; and spectrophotometry. Mutations can be engineered into a virus of the invention using genetic engineering techniques known to one of skill in the art.

As used herein, "TF ORF" refers to the transframe open reading frame.

As used herein, nsp2 refers to non-structural protein 2, which is one of at least 13 functional nonstructural proteins (nsps) generated by proteolytic cleavage of pp1a and pp1b. pp1a and pp1b are large replicase precursor proteins of arteriviruses, which are synthesized from the genomic mRNA template.

As used herein, nsp2TF refers to the transframe protein produced by the −2 frameshift mechanism described herein. Nsp2TF is encoded by all arteriviruses, except EAV.

As used herein, the phrases "−2 frameshifting" and "+1/−2 frameshifting" can be used interchangeably.

As used herein, a "porcine reproductive and respiratory syndrome virus" or "PRRSV" refers to a virus which causes the diseases PRRS, PEARS, SIRS, MSD and/or PIP (the term "PIP" now appears to be disfavored), including the Iowa strain of PRRSV, other strains of PRRSV found in the United States (e.g., VR 2332), strains of PRRSV found in Canada (e.g., IAF-exp91), strains of PRRSV found in Europe (e.g., Lelystad virus, PRRSV-10), and closely-related variants of these viruses which may have appeared and which will appear in the future.

An unaffected pig is a pig which has either not been exposed to a porcine reproductive and respiratory disease infectious agent, or which has been exposed to a porcine reproductive and respiratory disease infectious agent such as PRRSV but is not showing symptoms of the disease. An affected pig is one which shows symptoms of PRRS or from which PRRSV can be isolated.

"Nucleic acid" or "polynucleotide" as used herein refers to purine- and pyrimidine-containing polymers of any length, either polyribonucleotides or polydeoxyribonucleotide or mixed polyribo-polydeoxyribonucleotides. This includes single- and double-stranded molecules, i.e., cDNA, mRNA, DNA-DNA, DNA-RNA and RNA-RNA hybrids, as well as "protein nucleic acids" (PNA) formed by conjugating bases to an amino acid backbone. This also includes nucleic acids containing modified bases.

A "vector" is any means for the transfer of a nucleic acid into a host cell. A vector may be a replicon to which another DNA segment may be attached so as to bring about the replication of the attached segment. A "replicon" is any genetic element (e.g., plasmid, phage, cosmid, chromosome, virus) that functions as an autonomous unit of DNA replication in vivo, i.e., capable of replication under its own control. The term "vector" includes both viral and nonviral means for introducing the nucleic acid into a cell in vitro, ex vivo or in vivo. Viral vectors include alphavirus, retrovirus, adeno-associated virus, pox, baculovirus, vaccinia, herpes simplex, Epstein-Barr and adenovirus vectors. Non-viral vectors include, but are not limited to plasmids, liposomes, electrically charged lipids (cytofectins), DNA-protein complexes, and biopolymers. In addition to a nucleic acid, a vector may also contain one or more regulatory regions, and/or selectable markers useful in selecting, measuring, and monitoring nucleic acid transfer results (transfer to which tissues, duration of expression, etc.).

A "cassette" refers to a segment of DNA that can be inserted into a vector at specific restriction sites. The segment of DNA encodes a polypeptide of interest, and the cassette and restriction sites are designed to ensure insertion of the cassette in the proper reading frame for transcription and translation.

A cell has been "transfected" by exogenous or heterologous DNA when such DNA has been introduced inside the cell.

A cell has been "transformed" by exogenous or heterologous DNA when the transfected DNA effects a phenotypic change. The transforming DNA can be integrated (covalently linked) into chromosomal DNA making up the genome of the cell.

A "nucleic acid molecule" refers to the phosphate ester polymeric form of ribonucleosides (adenosine, guanosine, uridine or cytidine; "RNA molecules") or deoxyribonucleosides (deoxyadenosine, deoxyguanosine, deoxythymidine, or deoxycytidine; "DNA molecules"), or any phosphoester analogs thereof, such as phosphorothioates and thioesters, in either single stranded form, or a double-stranded helix. Double stranded DNA-DNA, DNA-RNA and RNA-RNA helices are possible. The term nucleic acid molecule, and in particular DNA or RNA molecule, refers only to the primary and secondary structure of the molecule, and does not limit it to any particular tertiary forms. Thus, this term includes double-stranded DNA found, inter alia, in linear or circular DNA molecules (e.g., restriction fragments), plasmids, and chromosomes. In discussing the structure of particular double-stranded DNA molecules, sequences may be described herein according to the normal convention of giving only the sequence in the 5' to 3' direction along the nontranscribed strand of DNA (i.e., the strand having a sequence homologous to the mRNA). A "recombinant DNA molecule" is a DNA molecule that has undergone a molecular biological manipulation.

As used herein, a "polypeptide" refers generally to peptides and proteins having more than eight amino acids.

"Conservatively modified variants" applies to both amino acid and nucleic acid sequences. With respect to particular nucleic acid sequences, conservatively modified variants refers to those nucleic acids which encode identical or essentially identical amino acid sequences, or where the nucleic acid does not encode an amino acid sequence, to essentially identical sequences. Because of the degeneracy of the genetic code, a large number of functionally identical nucleic acids encode any given polypeptide. For instance, the codons CGU, CGC, CGA, CGG, AGA, and AGG all encode the amino acid arginine. Thus, at every position where an arginine is specified by a codon, the codon can be altered to any of the corresponding codons described without altering the encoded polypeptide. Such nucleic acid variations are "silent substitutions" or "silent variations," which are one species of "conservatively modified variations." Every polynucleotide sequence described herein which encodes a polypeptide also describes every possible silent variation, except where otherwise noted. Thus, silent substitutions are an implied feature of every nucleic acid sequence which encodes an amino acid. One of skill will recognize that each codon in a nucleic acid (except AUG, which is ordinarily the only codon for methionine) can be modified to yield a functionally identical molecule by standard techniques. In some embodiments, the nucleotide sequences that encode a PAD are preferably optimized for expression in a particular host cell (e.g., yeast, mammalian, plant, fungal, and the like) used to produce the enzymes.

As to amino acid sequences, one of skill will recognize that individual substitutions, deletions or additions to a nucleic acid, peptide, polypeptide, or protein sequence which alters, adds or deletes a single amino acid or a small percentage of amino acids in the encoded sequence is a "conservatively modified variant" referred to herein as a "variant" where the alteration results in the substitution of an amino acid with a chemically similar amino acid. Conservative substitution tables providing functionally similar amino acids are well known in the art. See, for example, Davis et al., "Basic Methods in Molecular Biology" Appleton & Lange, Norwalk, Conn. (1994). Such conservatively modified variants are in addition to and do not exclude polymorphic variants, interspecies homologs, and alleles of the invention.

The following eight groups each contain amino acids that are conservative substitutions for one another: 1) Alanine (A), Glycine (G); 2) Aspartic acid (D), Glutamic acid (E); 3) Asparagine (N), Glutamine (Q); 4) Arginine (R), Lysine (K); 5) Isoleucine (I), Leucine (L), Methionine (M), Valine (V); 6) Phenylalanine (F), Tyrosine (Y), Tryptophan (W); 7) Serine (S), Threonine (T); and 8) Cysteine (C), Methionine (M) (see, e.g., Creighton, 1984, Proteins).

The terms "identical" or percent "identity," in the context of two or more nucleic acids or polypeptide sequences, refer to two or more sequences or subsequences that are the same or have a specified percentage of amino acid residues or nucleotides that are the same (i.e., about 70% identity, preferably 75%, 80%, 85%, 86%, 87%, 88%, 89%, 90%, 91%, 92%, 93%, 94%, 95%, 96%, 97%, 98%, 99%, or higher identity over a specified region (e.g., epitope of a nsp2TF protein of PRRSV), when compared and aligned for maximum correspondence over a comparison window or designated region) as measured using a BLAST or BLAST 2.0 sequence comparison algorithms with default parameters described below, or by manual alignment and visual inspection. Such sequences are then said to be "substantially identical." This definition also refers to the compliment of a test sequence. The definition also includes sequences that have deletions and/or additions, as well as those that have substitutions. As described below, the preferred algorithms can account for gaps and the like. Preferably, the identity exists over a region that is at least about 25 amino acids or nucleotides in length, or more preferably over a region that is 50-100 amino acids or nucleotides in length, or more preferably over the complete length of said two or more nucleic acids or polypeptide sequences.

For sequence comparison, typically one sequence acts as a reference sequence, to which test sequences are compared. When using a sequence comparison algorithm, test and reference sequences are entered into a computer, subsequence coordinates are designated, if necessary, and sequence algorithm program parameters are designated. Default program parameters can be used, or alternative parameters can be designated. The sequence comparison algorithm then calculates the percent sequence identities for the test sequences relative to the reference sequence, based on the program parameters.

A "comparison window", as used herein, includes reference to a segment of any one of the number of contiguous positions selected from the group consisting of from 20 to 600, usually about 50 to about 200, more usually about 100 to about 150 in which a sequence can be compared to a reference sequence of the same number of contiguous positions after the two sequences are optimally aligned. Methods of alignment of sequences for comparison are well-known in the art. Optimal alignment of sequences for comparison can be conducted, e.g., by the local homology algorithm of Smith & Waterman, 1991, Adv. Appi. Math. 2:482, by the homology alignment algorithm of Needleman & Wunsch, 1970, J. Mol. Biol. 48:443, by the search for similarity method of Pearson & Lipman, 1988, Proc. Nat'l. Acad. Sci. USA 85:2444, by computerized implementations of these algorithms (GAP, BESTFIT, FASTA, and TFASTA in the Wisconsin Genetics Software Package, Genetics Computer Group, 575 Science Dr., Madison, Wis.), or by manual alignment and visual inspection (see, e.g., Current Protocols in Molecular Biology (Ausubel et al., eds. 1995 supplement).

Another example of algorithm that is suitable for determining percent sequence identity and sequence similarity are the BLAST and BLAST 2.0 algorithms, which are described in Altschul et al., 1977, Nuc. Acids Res. 25:3389-3402 and Altschul et al., 1990, J. Mol. Biol. 215:403-410, respectively. Software for performing BLAST analyses is publicly available through the National Center for Biotechnology Information world wide web at ncbi.nlm.nih.gov/). This algorithm involves first identifying high scoring sequence pairs (HSPs) by identifying short words of length W in the query sequence, which either match or satisfy some positive-valued threshold score T when aligned with a word of the same length in a database sequence. T is referred to as the neighborhood word score threshold (Altschul et al., supra). These initial neighborhood word hits act as seeds for initiating searches to find longer HSPs containing them. The word hits are extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) or 10, M=5, N=−4 and a comparison of both strands. For amino acid sequences, the BLASTP program uses as defaults a wordlength of 3, and expectation (E) of 10, and the BLOSUM62 scoring matrix (see Henikoff & Henikoff, 1989, Proc. Natl. Acad. Sci. USA 89:10915) alignments (B) of 50, expectation (E) of 10, M=5, N=−4, and a comparison of both strands.

The BLAST algorithm also performs a statistical analysis of the similarity between two sequences (see, e.g., Karlin & Altschul, 1993, Proc. Nat'l. Acad. Sci. USA 90:5873-5787). One measure of similarity provided by the BLAST algorithm is the smallest sum probability (P(N)), which provides an indication of the probability by which a match between two nucleotide or amino acid sequences would occur by chance. For example, a nucleic acid is considered similar to a reference sequence if the smallest sum probability in a comparison of the test nucleic acid to the reference nucleic acid is less than about 0.2, more preferably less than about 0.01, and most preferably less than about 0.001.

An indication that two nucleic acid sequences or polypeptides are substantially identical is that the polypeptide encoded by the first nucleic acid is immunologically cross reactive with the antibodies raised against the polypeptide encoded by the second nucleic acid, as described below. Thus, a polypeptide is typically substantially identical to a second polypeptide, for example, where the two peptides differ only by conservative substitutions. Another indication that two nucleic acid sequences are substantially identical is that the two molecules or their complements hybridize to each other under stringent conditions, as described below. Yet another indication that two nucleic acid sequences are substantially identical is that the same primers can be used to amplify the sequence.

An "antigenic determinant" is, unless otherwise indicated, a molecule that is able to elicit an immune response in a particular animal or species. Antigenic determinants include proteinaceous molecules, i.e. polyaminoacid sequences, polypeptides, fragments, derivatives or variants that may include other moieties, for example, carbohydrate moieties, such as glycans, and/or lipid moieties.

Antigenic determinants of the present invention may also be heterologous, including antigenic determinants of neutralizing epitopes from other viruses, PRRSV strains or family, that cross-react with antibody or antiserum produced in response to a 2TF of the present invention, for example, antibodies to epitopes comprising SEQ ID NO:63, 64, and 65 heterodimers, or sequences that are at least 70% identical thereto, are able to elicit an immune response in a particular animal, such as a pig.

The phrase "biological sample" refers to a fluid or tissue of a mammal (e.g., a pig, rabbit, horse) that commonly contains antibodies or viral particles. Such components are known in the art and include, without limitation, blood, plasma, serum, spinal fluid, lymph fluid, secretions of the respiratory, intestinal or genitourinary tracts, tears, saliva, milk, white blood cells, and myelomas.

As used herein, an antibody is defined in terms consistent with that recognized within the art: they are multi-subunit proteins produced by a mammalian organism in response to an antigen challenge. The antibodies of the present invention include monoclonal antibodies and polyclonal antibodies, as well as fragments of such antibodies, including, but not limited to, Fab or F(ab')hd 2, and Fv fragments.

As used herein, the term 'specific' or 'specificity' or grammatical variations thereof, in the context of an antibody binding to a antigenic determinant, refers to the binding strength of an antibody to the antigenic determinant. The equilibrium constant for the dissociation of an antigen with an antigenic determinant-binding protein (KD) is a measure for the binding strength between an antigenic determinant and an antigen-binding site on the antigen-binding protein: A low KD value indicates a strong binding strength between an antigenic determinant and the antibody. As an alternative, the affinity can also be expressed as the affinity constant (KA), which is 1/KD). Typically, antibodies will bind to their antigenic determinant with a dissociation constant (KD) of $10^{-5}$ to $10^{-12}$ moles/liter or less, and preferably $10^{-7}$ to $10^{-12}$ moles/liter or less and more preferably $10^{-8}$ to $10^{-12}$ moles/liter (i.e. with an association constant (KA) of $10^{5}$ to $10^{12}$ liter/moles or more, and preferably $10^{7}$ to $10^{12}$ liter/moles or more and more preferably $10^{8}$ to $10^{12}$ liter/moles). A KD value greater than $10^{-4}$ mol/liter is generally considered to indicate non-specific binding. Preferably, an antibody of the invention will bind to the desired antigenic determinant with an affinity less than 500 nM, preferably less than 200 nM, more preferably less than 10 nM, such as less than 500 pM. Specific binding of an antibody to an antigenic determinant can be determined in any suitable manner known per se, including, for example, Scatchard analysis and/or competitive binding assays, such as radioimmunoassays (RIA), enzyme immunoassays (EIA) and sandwich competition assays, and the different variants thereof known in the art.

As used herein, the term "inactivated" means a vaccine containing an infectious organism that is no longer capable of replication and/or growth.

As used herein, the term "PRRSV" as used herein refers to all viruses belonging to species PRRSV in the genus Arterivirus within the family Arteriviridae.

The terms "protecting", "protection", "protective immunity" or "protective immune response," as used herein, are intended to mean that the host pig mounts an active immune response to the vaccine or polypeptides of the present invention, such that upon subsequent exposure to the virus or a virulent viral challenge, the pig is able to combat the infection. Thus, a protective immune response will decrease the incidence of morbidity and mortality from subsequent exposure to the virus among host pigs. Those skilled in the art will understand that in a commercial pig setting, the production of a protective immune response may be assessed by evaluating the effects of vaccination on the herd as a whole, e.g., there may still be morbidity and mortality in a minority of vaccinated pigs. Furthermore, protection also includes a lessening in severity of any gross or histopathological changes (e.g., lesions in the lung) and/or of symptoms of the PPRS disease, as compared to those changes or symptoms typically caused by the isolate in similar pigs which are unprotected (i.e., relative to an appropriate control). Thus, a protective immune response will decrease the symptoms of PRRSV, including but not limited to a reduction in the clinical signs or symptoms of PRRS comprising weight loss, decreased weight gain, lethargy, respiratory distress, "thumping" (forced expiration), fevers, roughened haircoats, sneezing, coughing, eye edema, conjunctivitis, gross lesions microscopic lung lesions, myocarditis, lymphadenitis, encephalitis and rhinitis compared to the control pig.

As used herein, the term "live virus" refers to a virus that retains the ability of infecting an appropriate subject (as opposed to inactivated (killed) or subunit vaccines).

As used herein, "immunogenically effective amount" refers to an amount, which is effective in reducing, eliminating, treating, preventing or controlling the symptoms of the PRRSV infections, diseases, disorders, or condition.

Arteriviruses

The order Nidovirales currently comprises the families Coronaviridae, Roniviridae, and Arteriviridae (de Groot et al., 2012; Gorbalenya et al., 2006). The latter includes equine arteritis virus (EAV), porcine reproductive and respiratory syndrome virus (PRRSV), lactate dehydrogenase-elevating virus (LDV), and simian hemorrhagic fever virus (SHFV), of which EAV and PRRSV are economically important veterinary pathogens (Snijder and Meulenberg, 1998; Snijder and Spaan, 2007). Nidoviruses employ single-stranded, polycistronic RNA genomes of positive polarity that direct the synthesis of the subunits of the replicative complex, including the RNA-dependent RNA polymerase and helicase. It should be noted that some coronaviruses, for example SARS-Coronavirus, infect humans.

Arteriviruses are small, enveloped viruses containing a single-stranded RNA genome of positive polarity (den Boon et al., 1991; Meulenberg et al., 1993). The genome of Arteriviruses is approximately 13- to 16-kb. The consequences of arterivirus infection are wide ranging, including asymptomatic, persistent, or acute infection, as well as abortion or lethal hemorrhagic fever.

Porcine reproductive and respiratory syndrome (PRRS) is an economically significant disease of swine throughout the world. It is characterized by late-term reproductive failure in sows and severe pneumonia in neonatal pigs. The etiological agent of PRRS is a small, enveloped virus herein referred to as PRRSV (Porcine Reproductive and Respiratory Syndrome Virus). PRRSV contains a single, positive-stranded RNA genome.

Genome Organization and Gene Expression in Plus-Strand RNA Viruses

Viruses are entirely dependent on the host cell for ribosomes and other components of the translational machinery for their protein synthesis. In eukaryotes, translation initiation largely depends on 5'-end dependent scanning of mRNAs during which the small ribosomal subunit, in a complex with initiation factors, first binds to the 5' cap structure and scans in a 5' to 3' direction until it encounters the first suitable initiation codon, at which point translation commences (Jackson 2010). Consequently, the vast majority of cellular mRNAs are essentially monocistronic, although efficient reinitiation can occur after translation of very short ORFs.

The fact that in eukaryotes the cellular translational machinery essentially only decodes the most 5'-proximal long open reading frame (ORF) of an mRNA imposes a considerable constraint on non-segmented RNA viruses, which must express a number of enzymatic and structural proteins in order to complete their replicative cycle. Strategies to overcome this limitation include the production of functionally monocistronic subgenomic mRNAs, the production of precursor polyproteins that are subsequently cleaved by virus- and/or host-encoded proteases, and the use of non-canonical translational mechanisms (such as internal ribosomal entry, leaky scanning, ribosomal frameshifting, and stop codon read through (Firth & Brierley, 2012)) by which additional ORFs may be translated from polycistronic mRNAs. Non-canonical translational mechanisms allow plus strand RNA viruses to express multiple proteins from a limited number of transcripts, regulate gene expression, and otherwise manipulate the host cell translational machinery for their own specific needs. These mechanisms can operate at the level of genome organization, translation, post-translational processing of polyprotein precursors and synthesis of additional subgenomic mRNAs.

Members of the order Nidovirales, which includes the RNA viruses with the largest genomes currently known, utilize many of these strategies (including polyprotein expression, the synthesis of multiple subgenomic RNAs, ribosomal frameshifting, and leaky scanning; FIG. 1A) to organize one of the most complex RNA virus replication cycles described to date (Perlman et al., 2009; Masters, 2006; Fang & Snijder, 2010; Gorbalenya et al., 2006).

The replicase gene of arteriviruses consists of 2 long open reading frames (ORFs), ORF1a and ORF1b, which occupy the 5'-proximal three quarters of the genome. ORF1a and ORF1b encode two large replicase precursor polyproteins, pp1a and the transframe fusion pp1ab, with expression of the latter depending on a −1 ribosomal frameshift in the short ORF1a/ORF1b overlap region (den Boon et al., 1991). This −1 ribosomal frameshifting mechanism is conserved among all members of the order Nidovirales.

Following their synthesis from the genomic mRNA template, pp1a and pp1ab are processed into functional nonstructural proteins (nsps) by a complex proteolytic cascade that is directed by four (PRRSV/LDV) or three (EAV) ORF1a-encoded proteinase domains (Ziebuhr et al., 2000; Fang and Snijder, 2010). Proteolytic cleavage of pp1a and pp1ab generates at least 13 functional nonstructural proteins (nsps), known as nsp1 to nsp12, with both the nsp1 and nsp7 regions being cleaved internally to generate nsp1α/nsp1β (PRRSV/LDV) and nsp7α/nsp7β, respectively (Ziebuhr et al., 2000; Fang and Snijder, 2010).

The 3'-proximal region of the arterivirus genome contains at least eight genes encoding the viral structural proteins, which are translated from a 5'- and 3'-coterminal nested set of subgenomic mRNAs (reviewed in Pasternak et al., 2006). With the exception of the smallest mRNA, the subgenomic mRNAs are structurally polycistronic but commonly only their 5'-proximal ORF is translated. Known exceptions are mRNAs 2 and 5 which are both bicistronic Ribosomal Frameshifting The genomes of a variety of viruses, including all current members of the order Nidovirales (Brierley et al., 1989; den Boon et al., 1991), harbor sequences that induce a proportion of translating ribosomes to shift −1 nt and continue translating in an alternative reading frame (Brierley et al., 2010; Miller & Giedroc, 2010). Where functionally important, this process is termed −1 programmed ribosomal frameshifting (−1 PRF).

The eukaryotic −1 frameshift site typically consists of a 'slippery' heptanucleotide fitting the consensus motif X_XXY_YYZ, where XXX normally represents any three identical nucleotides (though certain exceptions have been found), YYY represents strictly AAA or UUU, Z represents A, C or U, and underscores separate zero-frame codons (Brierley et al., 1992). This is generally followed by a stimulatory element that comprises a stable RNA secondary structure, such as a pseudoknot or stem-loop, beginning 5-9 nt downstream of the shift site (Brierley et al., 2010; Miller & Giedroc, 2010).

In contrast, −2 PRF is apparently much rarer, and until Applicants' discovery, very little was known about the potential shift sites or stimulatory elements. Prior to Applicants' discovery, there were very few, if any, examples of functional natural utilization of −2 frameshifting in eukaryotic systems. In diverse animals and fungi, expression of the cellular gene antizyme involves +1 frameshifting (Ivanov & Atkins, 2009). However, when mammalian antizyme is artificially expressed in the yeast *Saccharomyces cerevisiae*, the full-length antizyme product is expressed via −2 frameshifting (Matsufuji et al., 1996). Here the stimulatory elements comprise a stop codon 3' adjacent to the shift site (UGC_UCC_uga) and a 3'-proximal RNA pseudoknot structure. The −2 frameshift translation reads CSPD and frameshifting is thought to involve mainly P-site slippage on GC_UCC with an empty A-site.

In prokaryotic systems, relatively inefficient (about 2.2%) −2 frameshifting is used in the expression of the gpGT tail assembly protein in phage Mu, though the majority of dsDNA phages that express gpGT via frameshifting appear to utilize −1 frameshifting instead (Xu et al., 2004).

Sequence analysis strongly suggests that −2 frameshifting on CC_CUU_UUU is utilized in the expression of Gag-Pol in *Trichomonas vaginalis* virus 1 (TVV1; Su & Tai, 1996; Goodman et al., 2011). As with other totivirids, however, frameshifting in TVV1 is likely to be relatively inefficient as the Gag-Pol:Gag ratio in virions is extremely low (e.g. 1-2%; Dinman et al., 1991; Liu et al., 1998), which is in sharp contrast to the much higher efficiencies observed in studies for PRRSV −2 PRF described here (FIG. 7).

Efficient natural utilization of −2 PRF has not been previously described until Applicants' discovery. Applicants have demonstrated that PRRSV, one of the most economically important pathogens of swine, uses this mechanism to produce an nsp2-related transframe protein, nsp2TF. Bioinformatic analysis strongly suggests that such an nsp2TF product is encoded by all arteriviruses, with the striking exception of EAV in which the relevant region of ORF1a is substantially smaller and has diverged dramatically.

Applicants verified experimentally the efficient expression of nsp2TF in virus-infected cells in multiple independent immunoassays using nsp2- and nsp2TF-specific Abs. Applicants also confirmed the expression of nsp2TF and the exact site and direction of frameshifting via mass spectrometric analysis of proteins purified from infected cells. Applicants discovered, identified and characterized two nsp2TF knockout mutants that differ from WT virus by 2 and 9 nucleotide substitutions (all synonymous with respect to ORF1a); both exhibited a crippled, smaller plaque-size phenotype and reduced infectious progeny titers, which evidences the important role of nsp2TF in virus replication in cultured cells.

While typical −1 frameshift sites (X_XXY_YYZ) allow codon: anticodon re-pairing in both the P- and A-sites with mismatches only at the wobble positions, Applicants discovered that this is not so for −2 frameshifting on G_GUU_UUU, where perfect re-pairing is only maintained in the A-site (FIG. 5A). The nucleotide preceding the heptanucleotide is typically a G or an A in different arterivirus sequences; thus the post-shift P-site anticodon:codon duplex, if a duplex forms at all, may have mismatches at multiple positions. However, while integrity of the A-site duplex is strictly monitored by the translating ribosome (Demeshkina et al., 2012), the P-site duplex is not monitored so strictly and, even for −1 frameshifting, a number of variations on the canonical XXX are allowed, including UCC, GGA, GUU and GGU (Melian et al., 2010; Firth et al., 2010; den Boon et al., 1991; Loughran et al., 2011). The potential −2 frameshift site in TVV1 (CC_CUU_UUU) and the site of presumed −2 frameshifting in SHFV isolates HQ845737 and HQ845738 (G_GUC_UCU) also concur with the theme of perfect re-pairing in the A-site but reduced potential for re-pairing in the P-site.

With few exceptions, eukaryotic −1 frameshifting is stimulated by a 3'-proximal RNA secondary structure, as also documented extensively for the ORF1a/ORF1b 1 PRF that is conserved in arteriviruses and all other Nidoviruses (Brierley et al., 1989; den Boon et al., 1991; Brierley et al., 2010). Whether such structures are sufficient and/or necessary for the stimulation of −2 frameshifting remains to be determined.

However, Applicants' results indicate that −2 frameshifting in PRRSV, and other arteriviruses, may instead be stimulated by primary sequence elements including a highly conserved downstream CCCANCUCC motif that is separated from the shift site by 10 nt. Unstructured 3' sequences have also been implicated in the stimulation of +1 frameshifting in yeast (Guarraia et al., 2007) and −1 frameshifting in Semliki Forest alphavirus (Chung et al., 2010).

Applicants observed a variety of nsp2-related proteins in their analysis. A similar phenomenon was also observed in a previous study using a genotype II PRRSV isolate, VR2332, in which such nsp2-related products were assumed to derive from the use of alternative N- and/or C-terminal cleavage sites (Han et al., 2010). At least one of these products appears to correspond to nsp2TF, while some others appear to derive from the post-translational modifications observed in the pulse-chase experiments in FIG. 7.

Moreover, the G_GUU_UUU motif is also a suitable shift site for −1 frameshifting (Loughran et al., 2011) and a potential −1 frameshift product (nsp2N) was observed (FIGS. 3&7). In the vast majority of PRRSV sequences (205/212, including isolate SD01-08), such a frameshift would result in immediate termination at a −1 frame stop codon (with G_GUU_UUU_ga, G_GUU_UUU_ag and G_GUU_UUU_aa all being represented in different PRRSV isolates).

Mass spectrometry of the nsp2N band identified a peptide corresponding to the predicted C-terminus of a −1 frameshift product, although formally such a peptide could also be derived from internal cleavage of nsp2 or nsp2TF at this position. The identification of the nsp2N band as the −1 frameshift product was further supported by the fact that this protein was not observed upon expression of the SS mutant, in which the frameshift site is mutated. The identity and post-translational modification of the various nsp2-related products will continue to be studied, but the data accumulated thus far leave no doubt that efficient −2 PRF occurs, and is likely accompanied by a lower level of −1 frameshifting at the same nucleotide sequence.

The balance between the synthesis of the arterivirus pp1a and pp1ab replicase polyproteins is regulated by (another) ribosomal frameshift event, a −1 PRF (FIG. 1A), leading to an estimated pp1a:pp1ab ratio of about 4:1 (den Boon et al., 1991). It is now apparent that the expression level of the different non-structural proteins is further affected by efficient −2 PRF and −1 PRF to produce nsp2TF and (putatively) nsp2N, leading to a more complex series of ratios. Of the ribosomes that initiate at the AUG codon at the 5'end of ORF1a and translate nsp1α/nsp1β, ~20% will continue to synthesize nsp2TF and ~8% to synthesize nsp2N, while the other ~72% synthesize nsp2 to nsp8, and only ~14% translate the ORF1b-encoded proteins nsp9 to nsp12, including the viral RNA polymerase (nsp9) and helicase (nsp10).

Betaretroviruses and deltaretroviruses also employ two ribosomal frameshifts (both −1 PRF) in the expression of their Gag-Pro-Pol polyprotein (Jacks et al., 1987; Moore et al., 1987). In Betaretroviruses and deltaretroviruses, Gag, Pro and Pol are consecutive terminally-overlapping ORFs and, in contrast to the arteriviruses, the polymerase is translated by ribosomes that have frameshifted twice. Similarly, in many other RNA viruses, the polymerase (which is generally required in much lower quantities than certain other components of the replication complex) is either produced at a low level via a variety of mechanisms, such as stop codon read through or a relatively inefficiently translated genome segment, or excess polymerase is removed for example via degradation or sequestration in inclusion bodies (reviewed in Ahlquist, 2006).

PRRSV nsp2 is the largest replicase cleavage product, typically consisting of 1060 to 1196 amino acids, depending on the isolate. It is released by the autoproteolytic activities of the upstream papain-like protease (PLPβ) in nsp1β, which targets the nsp1β/2 site (den Boon et al. 1995), and cleavage of the nsp2/3 site by PLP2, the protease that resides in the N-terminal domain of nsp2 (Snijder et al., 1995). Nsp2 is a multidomain and multifunctional protein.

In addition to cleaving the nsp2/3 site, nsp2 functions as a co-factor for the nsp4 serine protease (SP) during processing of the C-terminal half of the ORF1a-encoded polypeptide (Wassenaar et al., 1997). The C-terminal domain of nsp2, but not nsp2TF, is a highly conserved Cys-rich domain of unknown function (Snijder et al., 1994). Furthermore, nsp2 is predicted to be a multi-spanning transmembrane, or TM, protein and has been implicated in the formation of the membranous replication structures that presumably scaffold the assembly of the viral replication complex (Knoops 2012; Pedersen et al., 1999).

Besides these critical roles in viral replication, recent studies have also implicated nsp2 in viral pathogenesis. Specifically, the PLP2 domain has been reported to possess deubiquitinating and deISGylating activities (Frias-Staheli, et al., 2007; Makarova et al., 2000; van Kasteren, et al., 2011; Sun et al., 2010, 2012). The biological significance of these activities was evidenced by the ability of PLP2 to inhibit type I interferon (IFN) activation and antagonize the antiviral effect of ISG15. Finally, certain regions of nsp2 that appear to be less- or non-essential for PRRSV replication are thought to play a role in the modulation of host immune responses in vivo (Chen et al., 2010; Sun et al., 2012).

The nsp2TF protein adds to the complexity of (potential) functions encoded in this region of the genome. The fact that nsp2TF protein is an important protein is confirmed by its conservation in three out of four distantly related arteriviruses and Applicants' reverse genetics studies. The frameshift signal is located just upstream of the region encoding the predicted nsp2 TM domain. Thus, nsp2 and nsp2TF share the PLP2 domain and the "hypervariable region" of nsp2, but the two proteins have distinct C-terminal segments. The C-terminal region of nsp2TF is shorter than that of nsp2 (177 aa shorter in PRRSV SD01-08) but, like nsp2, contains a number of predicted TM regions.

The −2 frameshift site in the nucleic acid sequence encoding nsp2 is encoded by 7 consecutive nucleotides of which the first five precede the nucleotides encoding the first amino acid of the TF coding part of the nsp2TF coding region and last two encode the first 2 nucleotides of the codon for the first amino acid of the TF coding part of the nsp2TF coding region.

Results from Applicants' reverse genetics analysis suggest that although nsp2TF is not essential for the viability of the virus, it is nonetheless essential for maximum virus fitness. As evidenced in the Experiments provided herein, when nsp2TF expression was knocked out (mutant KO2) or a C-terminally truncated nsp2TF was produced (mutant KO1), Applicants discovered that the virus was clearly crippled, displayed a phenotype characterized by lower titers of infectious progeny and reduced plaque size.

Figures 7A, 7B, 7C:
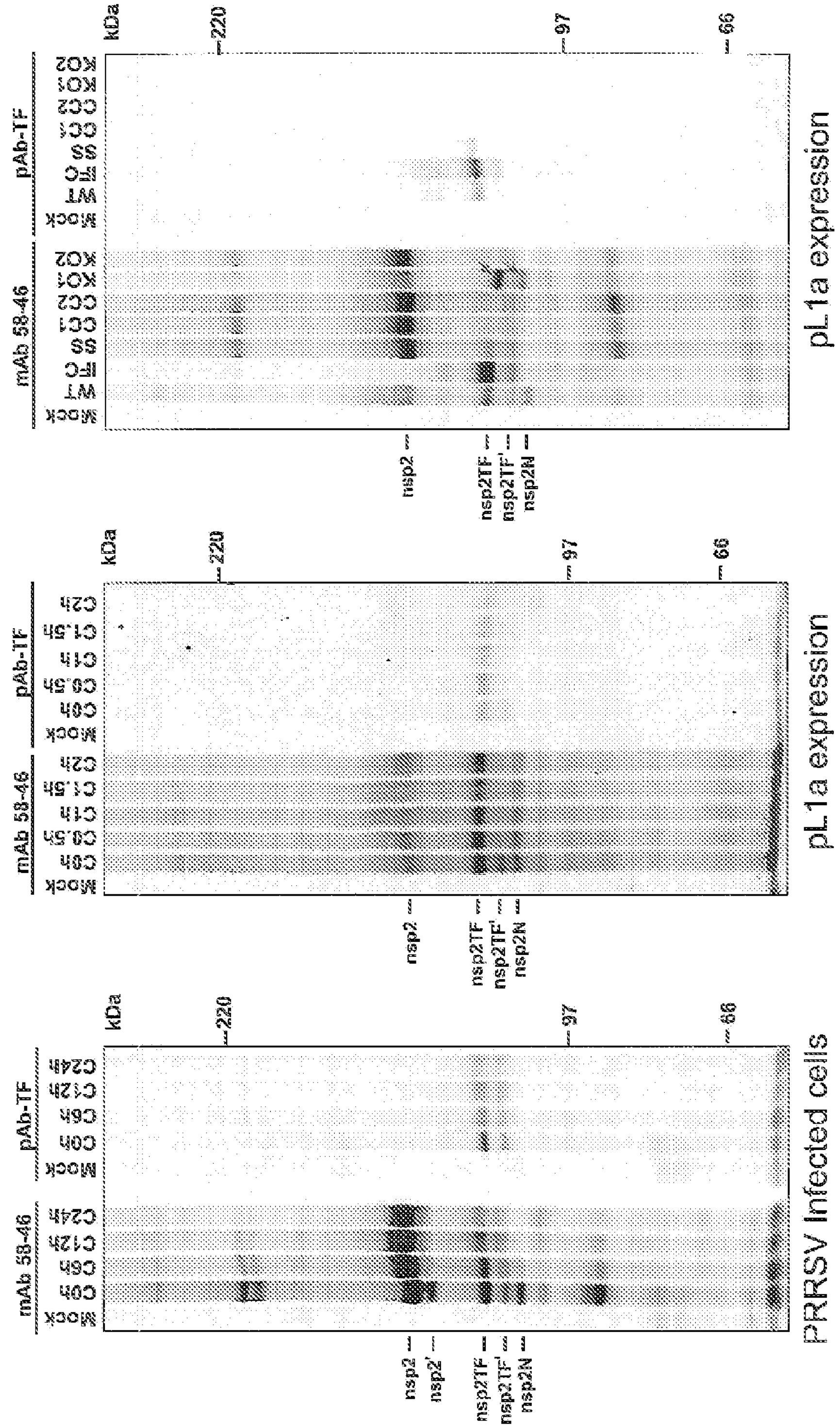
FIG. 7. Radioimmunoprecipitation analysis of nsp2-related products and nsp2TF mutants. Newly synthesized proteins were metabolically labeled with 35S, and cell lysates were immunoprecipitated with mAb58-46 or pAb-TF. Immunoprecipitated proteins were separated by SDS-PAGE and visualized by autoradiography. The positions of the molecular weight markers used during SDS-PAGE and nsp2-related products are indicated at the side of each panel.

Applicants designed the KO1 mutant using the least disruptive approach with only two stop codons introduced into the TF ORF, while the frameshift event itself was essentially not affected (FIG. 7C). Thus KO1 was expected to maintain the natural ratio between full-length nsp2 and the nsp2TF/nsp2N frameshift product(s). However, as shown by Applicants, the manipulation of the virus resulted in a crippled phenotype. This highlights the requirement for expression of full-length nsp2TF.

Applicants designed the KO2 mutant to completely knock out the frameshift signal and express only nsp2. In Applicants' experiments, KO2 showed the most impaired growth phenotype. Applicants' mutant, KO2, does not express nsp2TF, which is sufficient to impair virus replication (as demonstrated by the KO1 mutant). Knocking out the frameshift signal would also be expected to up-regulate the expression of all the downstream nsps (nsp3-12), which may disturb the carefully balanced expression levels of individual nsps. The levels of pp1a and pp1ab synthesis appear to be tightly controlled and disturbance of this balance affords various consequences. The consequences include effects on replicase proteolytic processing by nsp4 (also using nsp2 as a co-factor), the formation of replication complexes, or the up-regulation of RdRp and helicase expression, which all individually have the potential to directly or indirectly affect viral RNA synthesis.

There are several vaccines on the market using killed PRRS virus, or modified live virus (MLV). The presently available vaccines are generally effective against homologous strains, but there continue to be questions regarding vaccine safety and efficacy in protection against a wide array of heterologous PRRSV isolates in the field (Bøtner et al., 1997; Mengeling, 2005). Experimental PRRS vaccines (DNA, subunit, and peptide vaccines) (Huang et al., 2009; Kimman et al., 2009; Li et al., 2009; Wang et al., 2009) have not always generated sufficient protective immunity, and it remains to be determined whether such vaccines could be more effective than the existing MLVs and killed vaccines.

Accordingly, there is a significant need for more effective vaccines than are presently available.

Another drawback of current vaccines is that vaccinated pigs cannot be distinguished from pigs that have recovered from a natural infection. A genetically marked vaccine would allow the differentiation of vaccinated and naturally infected pigs, and would be valuable for PRRS control and eradication programs (Fang et al., 2008).

Applicants explored the nsp2 region for its potential application in PRRS vaccine development. Applicants' identification of −2 PRF and an overlapping ORF in the nsp2 region have important consequences for the rational design of novel viruses for use in PRRS vaccines. The manipulation of nucleic acid sequences in the nsp2-encoding region of the PRRSV genome may unintentionally affect the integrity and/or expression level of nsp2TF and all downstream replicase subunits, which may have a debilitating effect on virus replication. On the other hand, Applicants discovered the uses of such manipulation in the context of modified live virus vaccine design. Indeed, mutants such as KO1 and KO2, can be used, as well as further developed, for modified live virus vaccines.

The nsp2 region has also been explored for diagnostic assay development due to its highly immunogenic nature (Johnson et al., 2007; Brown et al., 2009). Sequence analysis showed that the C-terminal region of nsp2TF contains predicted B cell epitopes (Hopp and Woods, 1983; Larsen et al., 2006). This is further supported by production of the nsp2TF-specific rabbit antiserum using a predicted B cell epitope, CPKGVVTSVGESV, located at the 3' end of the protein.

Applicants' discovery and characterization of nsp2TF provide the foundation for the use of nsp2TF as a new antigen of the virus and/or a potential target for diagnostic assay development. Furthermore, mutations, truncations or deletions introduced in KO1 or KO2 mutants provide unique marker (regions) companion diagnostic assays for KO1 or KO2-based marker vaccine.

In addition to its application in disease control, the frameshift mechanism itself has significant applications in biotechnology development, in particular since few efficient and inducible frameshift signals are known. Efficient and inducible frameshift signals allow the efficient controlled expression of the second gene in a dicistronic construct. As Applicants discovered, TF expression is dependent on the presence of an RNA sequence motif (CCCANCUCC) downstream of the shift site, the nsp1β-coding sequence, and the conserved RNA sequence downstream of the shift site. The frameshift can be stimulated by nsp1β expressed in trans, and therefore nsp1β (together with the CCCANCUCC motif), or portions thereof, can be used as a molecular switch to activate and inactivate the expression of desired genes.

Applicants have discovered and identified an additional coding sequence present in the arterivirus genome, whose protein product, nsp2TF, plays a role in PRRSV replication. The nsp2TF protein itself and its expression mechanism (−2 PRF) have significant applications in biotechnology development and disease control.

Applicants have identified a new arterivirus protein, and demonstrated that −2 frameshifting is functionally utilized as a gene expression mechanism in eukaryotic systems.

Applicants' data reveals that expression of the arterivirus replicase proteins is affected by two distinct ribosomal frameshift events, so that the three regions nsp1/2, nsp3-8 and nsp9-12, are all expressed at different levels.

Applicants have discovered a novel ribosomal frameshift event that occurs during translation of the nsp2-encoding part of ORF1a of the PRRS virus. This frameshift event occurs in the central region of ORF1a and involves a conserved alternative ORF. Applicants have discovered and characterized the conserved alternate ORF (termed TF) which encodes and overlaps the part of ORF1a encoding the putative transmembrane domain of nsp2 (referred to herein as "TM") in most arteriviruses, including both genotypes of PRRSV (Type 1 and Type II), LDV and SHFV.

Applicants have discovered that this conserved alternative ORF (TF) is in the −2 reading frame relative to ORF1a, and is translated as a transframe fusion (nsp2TF) with the N-terminal half of nsp2 via −2 PRF. Applicants show that the −2 PRF that occurs at a conserved G_GUU_UUU motif does so with an efficiency in the order of 20%.

The resulting transframe protein (termed nsp2TF) was identified by Applicants and its expression was confirmed to occur via −2 PRF, in PRRSV-infected cells, using nsp2TF-specific antibodies. The TF domain consists of a unique 169-aa C-terminal region, encoded by the TF ORF, fused to the N-terminal 65-72% (depending on the specific strain) of nsp2. Consequently, the N-terminal segments of nsp2 and nsp2TF are identical, whereas compared to nsp2, nsp2TF is significantly shorter and contains a unique C-terminal domain.

Applicants' data from mass spectrometric analysis of PRRSV nsps further confirms the expression of nsp2TF and the site and direction of frameshifting. Applicants' experiments using site-directed mutagenesis of the frameshift site, G_GUU_UUU, and a highly conserved downstream CCCAxCUCC motif evidence that both elements are required for efficient frameshifting. Applicants further provide data demonstrating that the nsp1β region is also required for efficient frameshifting, and the frameshift can be trans-activated by co-expression of nsp1β.

Applicants discovered that mutations that partially or completely prevent the expression of nsp2TF impair PRRSV replication and result in a smaller plaque phenotype (50- to 100-fold reduced virus titers). Since all ribosomes shifting into the TF reading frame will not translate the downstream part of the replicase gene (encoding nsp3-nsp12), the combination of −2 PRF, together with the downstream ORF1a/ORF1b-1 PRF, results in an expression scheme within which the three replicase gene regions encoding nsp1-2, nsp3-8, and nsp9-12 are each translated at significantly different levels. Thus, the −2 PRF discovered by Applicants plays an important role in fine-tuning the expression levels of different components of the arterivirus replication complex.

As provided herein, the invention provides an arterivirus comprising nucleic acid encoding ORF1a or a functional part thereof, wherein said nucleic acid comprises at least one mutation resulting in reduced translation of nsp2TF and/or altered translation of one or more downstream products translated from said nucleic acid, in a cell infected by said arterivirus, when compared to a wild-type of said arterivirus.

In an embodiment of the invention, the arteriviruses optionally include one or more mutations that interfere with −2 ribosomal frameshifting at a −2 frameshifting site located in the region coding for nsp2. The −2 frameshift site in the nucleic acid sequence that codes for the nsp2 protein consists of 7 consecutive nucleotides of which the first five precede the nucleotides encoding the first amino acid of the TF coding part of the nsp2TF coding region and the last two constitute the first 2 nucleotides of the codon for the first amino acid encoded by the TF ORF.

In another embodiment, the arteriviruses of the invention optionally comprise at least one mutation in the frameshifting site GGU(U/C)U(U/C)U and/or the conserved CCCAN-CUCC motif. The arteriviruses of the invention optionally comprise one or more mutations in the nucleic acid sequence that encodes for the nsp1β protein coding region, which results in reduced −2 PRF, for example in a conserved GKYLQRRLQ motif (SEQ ID NO: 149). Said one or more mutations preferably comprise a K130 and/or R134 residue in nsp1β of Type 1 PRRSV, which correspond to K124 and/or R128 in nsp1β of Type 2 PRRSV. Said one or more mutations preferably comprise K130A and/or R134A for Type 1 PRRSV, and K124A and/or R128A for Type II PRRSV.

The invention further provides an arterivirus in which the nsp2TF function is reduced and/or absent in a cell infected by the arterivirus of the invention, when compared to a wild-type of said arterivirus. The previously mentioned arterivirus of the invention optionally comprises nucleic acid encoding ORF1a or a functional part thereof, wherein the nsp2TF amino acid sequence is altered, truncated or absent. The arterivirus of the invention optionally encodes a modified amino acid sequence of the TF domain, wherein said amino acid sequence is translated, and optionally provides epitopes that are absent in wild-type arterivirus but do not compromise the reading frame of ORF1a. The amino acid sequence of the TF domain preferably comprises SEQ ID Nos. 68 and 69 or sequences that are at least 70% identical thereto.

In an embodiment, the arteriviruses of the invention can be used to develop successful marker vaccines, or to determine whether or not a subject has been given a vaccine containing a genetic marker. In another embodiment, some of the arteriviruses provided by the invention can autonomously replicate. The arteriviruses of the invention can be PRRSV, including but not limited to Type 1 (European genotype) PRRSV, Type II (North American genotype) PRRSV including the Asian highly pathogenic variants (HP-PRRSV), or a combination thereof, or lactate dehydrogenase-elevating virus (LDV) or simian hemorrhagic fever virus (SHFV).

Additionally, an embodiment of the invention provides an RNA or a cDNA encoding any of the arteriviruses provided herein. Provided herein are vaccines or immunogenic compositions, which comprise any of the arteriviruses of the invention, the cDNA described above, or a combination thereof, and optionally a pharmaceutically acceptable carrier or diluent. Also provided in an embodiment of the invention are vaccines or immunogenic compositions which optionally comprise an adjuvant, an excipient, or a combination thereof.

In another embodiment, the invention provides methods of inducing an immune response to an arterivirus in a subject, comprising administering to the subject an effective amount of a composition of the invention. The subject may be an animal.

The invention provides an isolated or recombinant protein, comprising a full-length or partial arterivirus nsp2TF protein, preferably comprising amino acid sequences depicted in SEQ ID NO: 36, 45, and 76 and partial sequences 46-67 and 77-91 or sequences that are at least 70% identical thereto. Said protein is preferably fused to another protein and/or tagged, for example with a Myc-tag (e.g. N-ILKKATAYIL-C, N-EQKLISEEDL-C), HA-tag (e.g. N-YPYDVP-C), His-tag (e.g. 6×His), FLAG-tag (e.g. N-DYKDDDDK-C), GST tag and/or biotin-tag, as is known to the skilled person.

Further, in an embodiment of the invention, an isolated or recombinant antibody is provided, and the antibody can specifically bind to the arterivirus nsp2TF protein or a protein of the invention. Said antibody preferably binds to the TF domain of an arterivirus nsp2TF protein, or a protein having an amino acid sequence as depicted in SEQ ID NOS 63, 64, or 65 or which is at least 70% identical thereto.

Provided by an embodiment of the invention is a method of detecting the presence of an antibody to an arterivirus in a biological sample, said method comprising contacting a biological sample with an amount of a nsp2TF antigen or a part thereof; detecting the presence or absence of a complex between the nsp2TF antigen and an antibody, using a detection system; and determining the presence or absence of a complex between the nsp2TF antigen and an antibody, wherein the presence of a complex indicates an immune response to an arterivirus.

Another embodiment of the invention provides a method for determining whether a biological sample comprises an antibody directed against arterivirus, wherein said method comprises detecting the presence of an nsp2TF specific antibody in the biological sample.

The invention also provides a method for distinguishing a subject infected with wild-type arterivirus and/or vaccinated with an unmodified arterivirus strain, from a subject vaccinated with a vaccine of the invention, where the method comprises providing a sample from the test subject, determining in the sample, qualitatively, or quantitatively, or both qualitatively and quantitatively, the presence or absence of mutations affecting −2 ribosomal frameshifting at the −2 frameshifting site located 5' of the nucleic acid sequence encoding nsp2TF, or modifications to the nucleic acid sequence encoding nsp2TF; and/or determining in the sample the presence of antibodies against an immunogenic epitope specific for the vaccine; and/or determining in the sample the presence of antibodies against an epitope expressed by said wild-type or unmodified arterivirus but not present in the vaccine.

Further, an embodiment of the invention provides a method of typing an arterivirus in a biological sample, where the method comprises determining the presence and/or sequence of a −2 frameshifting site located in the nucleic acid sequence that encodes for the nsp2 protein; and/or determining the presence and/or sequence of an nsp2TF coding region in the arterivirus.

Another embodiment of the invention is a nucleic acid comprising an arterivirus −2 frameshift site in operable linkage with a nucleic acid sequence that encodes for a protein, where the protein is not an arterivirus protein, and the nucleic acid preferably further comprises a ribosomal translation start codon 5' of the −2 frameshift site. The arterivirus −2 frameshift in the nucleic acid of the invention may comprise the sequence GGU(U/C)U(U/C)U and/or CCCANCUCC. Additionally, the invention provides an expression system, comprising one of the nucleic acids of the invention, where the expression system optionally further comprises nsp1β or a functional part thereof.

An embodiment of the invention provides a method for determining whether an agent is capable of interfering with ribosomal frameshifting at the −2 frameshifting site located in the nucleic acid sequence that encodes for the nsp2 protein, where the method comprises providing a translation system that is permissive for frameshifting at said site with a nucleic acid encoding a genetic marker or reporter in operable linkage with said site, contacting the translation system with the agent. incubating the translation system and agent mixture to allow for translation of said nucleic acid; and determining the presence or absence of a partial translation product encoded by the nucleic acid.

In one embodiment of the invention, the translation system of the method of the invention provided above can comprise an arterivirus nsp1beta protein or functional part thereof and/or is a cell. The agent of the method of the invention provided above can be selected from the group consisting of antisense DNA, antisense RNA, siRNA, microRNA, nucleic acid analogues, peptides, or chemical compounds.

In some embodiments, the invention provides pharmaceutical compositions, which comprise an effective amount of an agent capable of interfering with −2 frameshifting in an arterivirus, and optionally a pharmaceutically acceptable carrier or diluent. The invention further provides a method of treating an animal infected by an arterivirus, comprising administering to the animal an effective amount of the pharmaceutical composition of the invention.

Additionally, an embodiment of the invention provides an expression cassette, which comprises nucleic acid encoding an arterivirus nsp2TF protein in operable linkage with a heterologous promoter. The invention further provides a cell that comprises the expression cassette of the invention. A cell of the invention optionally comprises an expression cassette that is integrated into a chromosome of the cell. Any of the cells of the invention can further comprise any arterivirus as provided by the invention or a cDNA of the invention. The invention also provides an arterivirus packaging cell line comprising a cell of the invention. The invention also provides an nsp2TF-expressing stable cell line comprising a cell of the invention. Further, the cells of the cell line provided by the invention express nsp2TF from a heterologous promoter. The invention also provides kits for any of the methods of the invention.

An embodiment of the invention provides immunogenic compositions capable of inducing or eliciting an immune response against an arterivirus. The compositions of the invention can comprise a vector, comprising one or more of any of the sequences provided in the sequence listing herein, or comprising one or more of constructs pL1a, pLnsp2-8, pLnsp1-2, pLnsp1β-2, pLnsp1βcc-2, pLnsp2, pLnsp1-3, pLnsp1β-3, pLnsp2-3, pLnsp2-3-IFC, pLnsp1β, pL1a-IFC, pL1a-KO1, pL1a-KO2, pL1a-SS, pL1a-CC1, pL1a-CC2, pSD01-08-IFC, pSD01 08-KO1, pSD01 08-KO2, and pLnsp1βcc-2, or any portion, fragment or combination thereof, and a pharmacologically acceptable carrier.

An embodiment of the invention provides methods of inducing an immune response against an arterivirus including LDV, SHFV, and PRRSV in an animal susceptible to said arterivirus (LDV, SHFV, or PRRSV, respectively) infection, administering an effective amount of a composition to the animal, and a pharmaceutically acceptable carrier, wherein said composition causes the inducement of an immune response in the animal.

An embodiment of the invention provides arteriviruses, comprising one or more mutations in open reading frame ORF1a, wherein said mutations are such that nsp2TF production in the arterivirus is altered, reduced or altogether eliminated.

An embodiment of the invention provides an in vitro method of detecting, identifying or quantifying an immune response to porcine reproductive respiratory syndrome virus (PRRSV), comprising contacting a biological sample with nonstructural protein 2 transframe protein (nsp2TF) antigen derived from PRRSV, wherein antibodies in the biological sample bind to the nsp2TF antigen, introducing a detection system for detecting the presence or absence of a complex between the nsp2TF antigen and an antibody, and determining, quantitatively or qualitatively, or both quantitatively and qualitatively, the presence or absence of a complex between the nsp2TF antigen and an antibody, wherein the presence of a complex indicates an immune response to PRRSV.

The ability of a compound or composition described herein to treat or prevent a disease caused by an arterivirus, including but not limited to PRRSV, may be determined by using assays well known to the art. For example, the design of vaccination protocols, evaluation, data analysis, and quantification of immune response may be used to determine the ability of a compound of the invention to treat or prevent a disease caused by an arterivirus.

In addition, the ability of a compound or composition to treat or prevent a disease caused by an arterivirus, including but not limited to PRRSV, may be determined using the tests known and understood by those of skill in the art. For example, suitable assays for use with the compositions and methods of the invention include, but are not limited to, antibody-based assays, nucleic acid-based assays, nucleic acid-based differential assays, such as fluorescent microsphere immunoassay, and real-time RT-PCR.

The invention further provides a arterivirus, comprising one or more mutations in ORF1a, wherein the nsp2TF protein expressed in the arterivirus is altered, truncated, or absent. According to the invention, the mutation in the arterivirus comprises one or more mutations that interfere with −2 frameshifting at the 5' end of the TF coding region and/or mutations in the 169-codon TF coding region. Mutations in the TF coding region may comprise an insertion of one of more stop codons in the TF coding region, a substitutions, a deletion, or a combination thereof. The arterivirus of the invention may further comprise a mutation in the CCCANCUC motif. A mutation in the arterivirus of the invention can optionally comprise a deletion in the nucleic acid sequence that encodes the nsp1β protein.

The arterivirus of the invention can be any arterivirus, including but not limited to PRRSV, including but not limited to Type 1 PRRSV (European genotype), Type 2 PRRSV (North American genotype), any variants of both genotypes, recombinants within/between genotype and/or combinations thereof, or lactate dehydrogenase-elevating virus (LDV), or simian hemorrhagic fever virus (SHFV).

The arteriviruses of the invention can also comprise the introduction of a genetic marker.

The invention provides vaccine compositions comprising one or more of the arteriviruses of the invention, and a pharmaceutically acceptable carrier. The invention also provides immunogenic compositions, comprising one or more of the arteriviruses of the invention, and a pharmaceutically acceptable carrier. The invention provides methods of inducing an immune response against an arterivirus in an animal susceptible to arterivirus infection, wherein the methods comprise the administration of an effective amount of a composition comprising one or more of the immunogenic compositions of the invention, wherein said immune response in the animal is induced. The vaccine compositions and immunogenic compositions can be used in any animal, including, but not limited to, mammals, humans, and pigs.

The invention provides a pharmaceutical composition, comprising an effective amount of an inhibitory nucleic acid or nucleic acid analogue, wherein the nucleic acid or nucleic acid analogue inhibits the −2 PRF mechanisms in an arterivirus, and a pharmaceutically acceptable carrier and/or diluent. The pharmaceutical compositions of the invention can optionally comprise inhibitory nucleic acid selected from the group consisting of antisense DNA, antisense RNA, ad microRNA, locked nucleic acid, peptide nucleic acid, morphilino oligonucleotides, or other small molecule, or a combination thereof.

The invention provides methods of treating an animal infected by an arterivirus, comprising administering to the animal an effective amount of one or more of the pharmaceutical compositions of the invention.

The invention further provides expression systems for controlling the expression of one or more exogenous genes, comprising inserting into a nucleic acid construct one or more frameshift signals from an arterivirus, and one or more nucleic acid molecules encoding one or more exogenous genes. The expression systems of the invention further provide the insertion into the nucleic acid construct one or more frameshift signals, wherein the frameshift signals are G_GUU_UUU, G_GUC_UCU, G_AUU_UUU, G_GUU_UUC, CCCANCUCC, or a combination thereof, with or without co-expression of nsp1β.

The invention provides arterivirus knock-out mutants for use in vaccines, and genetic expression systems, wherein arterivirus nucleic acid encoding nsp2TF or a functional part thereof has been partially inactivated in the viral genome. The invention also provides arterivirus knock-out mutants, wherein arterivirus nucleic acid encoding nsp2TF or a functional part thereof has been completely inactivated in the viral genome.

The invention provides an in vitro method of detecting the presence of an antibody to an arterivirus in a biological sample, wherein a biological sample is contacted with an amount of an antigen to a nonstructural protein 2 transframe protein (nsp2TF) derived from an arterivirus, and using a detection system to detect the presence or absence of a complex between the nsp2TF antigen and an antibody, wherein a complex between the nsp2TF antigen and an antibody will occur only if the biological sample contains an antibody to the antigen, and wherein the presence of a complex indicates an immune response to an arterivirus.

The invention provides an in vitro method of determining the presence or absence of nsp2TF-related nucleic acids, including the frameshift site, the conserved downstream sequences of nsp2TF, and the entire nsp2TF ORF, wherein the determination is quantitative, qualitative, or both quantitative and qualitative.

The invention provides vaccine constructs wherein the nsp2TF protein is expressed and/or altered. The invention further provides vaccine constructs wherein the nsp2TF protein expression is knocked out completely or partially. The invention also provides vaccine constructs wherein the expression level of the nsp2TF protein and all downstream nonstructural proteins are altered, including, but not limited to wherein the expression level of the nsp2TF protein is lowered, increased, or enhanced. The invention further provides vaccine constructs wherein the nsp2TF protein itself is substantially or partially or subtly altered or enhanced. The vaccine constructs of the invention, as provided herein, can be utilized in and for any arterivirus species.

The invention provides the use of a recombinant virus, including but not limited to a recombinant arterivirus, as a vaccine, wherein expression of nsp2TF is knocked out completely or partially, or wherein expression of nsp2TF and all downstream nonstructural proteins are altered. The invention provides the use of a recombinant virus, including but not limited to a recombinant arterivirus, as a vaccine, wherein nsp2TF is mutated, truncated, or otherwise altered.

The invention provides the use of a recombinant virus, including but not limited to a recombinant arterivirus, as a vaccine, wherein the frameshift efficiency is altered such that the overall regulation of replicase expression is disrupted, disordered or interrupted. The recombinant virus of the invention, as provided herein, can be any virus species. The recombinant virus of the invention, as provided herein, can be of any arterivirus species, including but not limited to any lactate dehydrogenase-elevating virus (LDV), any simian hemorrhagic fever virus (SHFV), or any PRRS virus species, including but not limited to Type 1 (European genotype) PRRSV and Type II (North American genotype) PRRSV, Asian variants or combinations thereof.

The invention provides an isolated, purified nsp2TF protein, as well as proteins and/or peptides containing an immunogenic epitope of the TF domain, or any nucleic acid, including a ribonucleic acid, coding for the nsp2TF protein or TF domain.

Also provided by the invention are methods for producing immunogenic compositions comprising isolated, purified nsp2TF protein, as well as proteins and/or peptides containing an immunogenic epitope of the TF domain, or any nucleic acid, including a ribonucleic acid, coding for the nsp2TF protein or TF domain, or a combination thereof. The invention provides use of nsp2TF as an intracellular or extracellular protein, or as a virion protein, to elicit a response in the immune system of an animal, wherein the animal includes, but is not limited to humans and pigs. According to the invention, the immune response can be, but is not limited to, an adaptive, acquired, humoral, cell-mediated, innate, passive, or active immune response.

The invention provides for methods for modifying the TF domain such that the cellular localization of the nsp2TF protein is altered, such that the deubiquitination function of the nsp2TF protein is impaired, and wherein the deubiquitination activity of the nsp2TF protein is reduced or inhibited. As per the invention, the modification of the TF domain can be done by mutation, the use of small compounds, the use of peptides, or other art-recognized methods of modifying a protein domain.

The invention provides the use of nsp2TF in diagnostic tests, including but not limited to diagnostic assays for vaccine compositions containing a genetic marker including but not limited to mutations that alter or delete specific sequences in the TF coding region or the nsp2TF amino acid sequence.

The invention provides the use of the nsp2TF protein or the TF domain for an antibody-based assay. The invention further provides the use of the TF coding region, and/or the frameshift sequences for a nucleic acid-based assay.

The invention provide the use of arterivirus-derived −2 PRF-inducing nucleic acid sequences in biotechnological applications, including but not limited to expression cassettes for expression of proteins or other molecules. Further provided are methods of inducing the expression of a protein of interest, including but not limited to a foreign or non-native or heterologous protein or combinations thereof, using one or more arterivirus-derived −2 PRF inducing nucleic acid sequences in a construct of choice. The arterivirus-derived −2 PRF inducing nucleic acid sequences for use in the invention can optionally include those expressing nsp1β. The invention provides the use of the G_GUU_UUU motif, G_GUC_UCU motif, CCCANCUCC motif, and or the nsp1β protein, or a combination thereof, from any arterivirus species, as stimulators and/or inducers of the −2 frameshifting mechanism in gene expression systems. The G_GUU_UUU motif, G_GUC_UCU motif, CCCANCUCC motif, and/or the nsp1β protein, or a combination thereof, can be from any virus species possessing the −2 PRF mechanism, including but not limited to any arterivirus species, including all currently known arterivirus species, as well as any later-identified viruses possessing the −2PRF mechanism. The invention provides methods for identifying compounds for modulating, inhibiting, or altering nsp1β-mediated frameshifting in any virus, or any biological system.

The following Examples are intended to illustrate the above invention and should not be construed as to narrow its scope. One skilled in the art will readily recognize that the Examples suggest many other ways in which the invention could be practiced. It should be understood that numerous variations and modifications may be made while remaining within the scope of the invention.

EXAMPLES

Example 1

Computational Analysis of ORF1a Regions from PRRSV

The ORF1a sequences of 212 PRRSV isolates currently available in GenBank were extracted, translated, aligned, and back-translated to a nucleotide sequence alignment. Both European (EU; genotype I) and North American (NA; genotype II) isolates, which typically share 50-55% aa identity within pp1a, were included. Next, the alignment was analyzed for conservation at ORF1a synonymous sites, as described previously (Firth et al., 2011b).

Methods:

PRRSV, LDV, SHFV and EAV nucleotide sequences in Genbank with full coverage of the ORF1a coding sequence were identified by applying NCBI tblastn (Altschul et al., 1990) to the pp1a peptide sequence derived from GenBank sequences NC_001961 (PRRSV-NA), NC_001639 (LDV), NC_003092 (SHFV) and NC 002532 (EAV).

Respectively 218, 2, 3 and 32 sequences were retrieved, and the accession numbers of sequences used in the bioinformatic analysis are as follows: PRRSV (EU genotype): M96262, AY366525, AY375474, AY588319, DQ489311, DQ864705, EU076704, FJ349261, GQ461593, GU047344, GU047345, GU067771, GU737264, JF276430, JF276431, JF276432, JF276433, JF276434, JF276435, JF802085.

PRRSV (NA genotype): NC_001961=AF046869, AB288356, AF066183, AF159149, AF176348, AF184212, AF303354, AF303355, AF303356, AF303357, AF325691, AF331831, AF494042, AY032626, AY150312, AY150564, AY262352, AY424271, AY457635, AY545985, AY585241, AY612613, DQ056373, DQ176019, DQ176020, DQ176021, DQ217415, DQ459471, DQ473474, DQ779791, DQ988080, EF075945, EF112445, EF112446, EF112447, EF153486, EF484031, EF484033, EF488048, EF488739, EF517962, EF532801, EF532802, EF532803, EF532804, EF532805, EF532806, EF532807, EF532808, EF532809, EF532810, EF532811, EF532812, EF532813, EF532814, EF532815, EF532816, EF532817, EF532818, EF532819, EF535999, EF536000, EF536001, EF536002, EF536003, EF635006, EF641008, EU097706, EU097707, EU106888, EU109502, EU109503, EU144079, EU187484, EU200961, EU200962, EU236259, EU262603, EU360128, EU360129, EU360130, EU624117, EU678352, EU708726, EU807840, EU825723, EU825724, EU860248, EU860249, EU864231, EU864232, EU864233, EU880431, EU880432, EU880433, EU880434, EU880435, EU880436, EU880437, EU880438, EU880439, EU880440, EU880441, EU880442, EU880443, EU939312, FJ175687, FJ175688, FJ175689, FJ393456, FJ393457, FJ393458, FJ393459, FJ394029, FJ536165, FJ548851, FJ548852, FJ548853, FJ548854, FJ548855, FJ797690, FJ889129, FJ895329, FJ899592, GQ330474, GQ351601, GQ359108, GQ374441, GQ374442, GQ475526, GQ499193, GQ499194, GQ499195, GQ499196, GQ857656, GU143913, GU168567, GU168568, GU168569, GU169411, GU232735, GU232736, GU232737, GU232738, GU269541, GU454850, GU461292, HM011104, HM016158, HM016159, HM189676, HM214913, HM214914, HM214915, HM853673, HQ233604, HQ233605, HQ315835, HQ315836, HQ315837, HQ401282, HQ416720, HQ699067, HQ843178, HQ843179, HQ843180, HQ843181, JF268672, JF268673, JF268674, JF268675, JF268676, JF268677, JF268678, JF268679, JF268680, JF268681, JF268682, JF268683, JF268684, JF748717, JF748718, JF796180, JF800911, JN256115, JN387271, JN387272, JN387273, JN387274, JN626287, JN662424, U87392. LDV: NC_001639=U15146, L13298. SHFV: NC_003092=AF180391, HQ845737, HQ845738. EAV: NC_002532=X53459, AY349167, AY349168, DQ846750, EU252113, EU252114, EU586273, EU586274, EU586275, GQ903794, GQ903795, GQ903796, GQ903797, GQ903798, GQ903799, GQ903800, GQ903801, GQ903802, GQ903803, GQ903804, GQ903805, GQ903806, GQ903807, GQ903808, GQ903809, GQ903810, GQ903811, JN211316, JN211317, JN211318, JN211319, JN211320.

Six ORF1a-defective PRRSV sequences were removed from subsequent analyses. Within each group, the polyprotein-encoding sequences were extracted, translated, aligned and back-translated to produce nucleotide sequence alignments using EMBOSS and Clustal (Rice et al., 2000; Larkin et al., 2007). Synonymous site conservation was calculated as described previously (Firth et al., 2011b).

Results:

The analysis revealed a striking and highly statistically significant ($p<10^{-64}$) increase in synonymous site conservation in a region covering 169 codons towards the 3' end of the nsp2-encoding sequence (FIG. 1). Within this region the mean synonymous substitution rate was reduced to 47% of the ORF1a average. Such peaks in synonymous site conservation are generally indicative of functionally important overlapping elements—either coding or non-coding.

In this case, an inspection of the positions of stop codons in the −1 and +2 reading frames relative to ORF1a, in all 212 sequences, revealed an almost complete absence of stop codons in the +1 reading frame in a region corresponding precisely to the region of enhanced conservation (FIG. 1B). This suggests an overlapping coding sequence in the +1 reading frame as a possible explanation for the enhanced conservation at ORF1a synonymous sites. Enhanced synonymous site conservation observed near the 5' end of ORF1a likely corresponds to functionally important non-coding elements, such as higher order RNA structures involved in replication and/or subgenomic RNA synthesis (van den Born et al., 2004; Lu et al., 2011).

Inspection of the genomes of other arterivirus species revealed further evidence for a +1 frame ORF overlapping the equivalent region of ORF1a. Currently, three SHFV sequences are available (Lauck et al., 2011). With pairwise aa identities within pp1a of just 35-37%, these sequences are too divergent for the synonymous site conservation analysis. However, the conserved presence of a 220-226 codon ORF in the +1 frame in such divergent sequences is, in itself, statistically significant (FIG. 1C; $p<10^{-10}$).

The statistical significance of the conserved presence of the long TF ORF (FIG. 1C) in the three highly divergent SHFV sequences was evaluated by randomly shuffling ORF1a-frame codon columns within the TF ORF region and calculating what fraction of shuffling preserve an open reading frame in the +1 frame. This procedure controls for any bias for or against random long +1 frame ORFs due to ORF1a-frame amino acid usage, codon usage, or nucleotide biases, and also controls for phylogenetic non-independence. In fact, the proportion of randomizations that preserve a +1 frame ORF was too small to estimate directly (0 occurrences in 4000 randomizations), so it was instead estimated from the mean number (per randomized alignment) of +1 frame alignment codon columns containing stop codons in one or more sequences (viz. 24.70), assuming Poisson statistics.

Using this method, the p-value for the long +1 frame ORF occurring by chance in this region of the SHFV alignment is $1.9\times10^{-11}$. Neither this statistic for SHFV ($1.9\times10^{-11}$), nor the conservation statistic quoted in the main text for PRRSV ($1\times10^{-64}$) have been corrected for multiple tests; i.e. in principle one might consider testing the whole genome (~15,000 nt) for conserved regions and/or conserved ORFs of ~200 codons and, in principle, one might apply such an analysis to the ~1000 RNA virus species represented in GenBank, making a total of ~25,000 independent tests. Thus, the p-values should be scaled by ~25,000 (giving $2.5\times10^{-60}$ and $4.8\times10^{-7}$, respectively), though a correction for multiple testing is not in fact required for the SHFV statistic, since the location of the 5' end of the TF ORF in SHFV is known a priori (it aligns to the 5' end of the TF ORF in PRRSV).

A 169-codon ORF is also present in one (LDV-P) of two published LDV sequences, but in the second (LDV-C) the ORF is disrupted by a single stop codon. To assess the likeliness of a sequencing error in the LDV-C sequence, we sequenced the relevant region of an additional LDV isolate (795 nt, including the last 158 codons of TF; GenBank accession #JX258842).

The new sequence is divergent from both LDV-P and LDV-C (locally 83-90% nt identity) and does not contain the TF-frame stop codon present in LDV-C. Remarkably, no evidence for a corresponding ORF was found in EAV. In fact, in this part of the genome, EAV is highly divergent from other arteriviruses and the nsp2 region is greatly reduced in size.

At the 5' end of the conserved TF ORF, there is a G_GUU_UUU motif (underscores separate ORF1a codons) that is present in 206/212 PRRSV sequences (4/212 have G_GUU_UUC), both LDV sequences, and one SHFV sequence. Meanwhile the other two SHFV sequences have G_GUC_UCU at the corresponding position. Significantly, the ‘G’ at position 1 is conserved despite the corresponding ORF1a codon being CAG (Gln), UGG (Trp), or CGG (Arg) in different PRRSV isolates (FIG. 2A). This motif could facilitate −2 PRF from ORF1a into the overlapping ORF.

We were not able to predict convincing 3' RNA secondary structures at a distance of 5-9 nt that might (by analogy to −1 PRF sites) be expected to be present, though. We could not definitively rule out the existence of such a structure, as long-range base-pairings and/or structures involving complex tertiary interactions can be difficult to detect based on computational analysis alone.

We observed a highly conserved CCCANCUCC motif at a distance of 10 nt downstream of the G_GUU_UUU sequence. This motif is present in LDV, all three SHFV sequences, and 211/212 PRRSV sequences. Such high conservation could reflect amino acid constraints (in two overlapping reading frames) but might also represent (part of) a frameshift stimulatory RNA sequence.

In PRRSV, −2 frameshifting at the G_GUU_UUU sequence would produce a transframe fusion protein, comprising the N-terminal 65-72% (typically 718-849 aa, depending on isolate) of nsp2 fused to the 169 aa encoded by the overlapping ORF (FIG. 1A). We now refer to the overlapping ORF as TF and we refer to the predicted transframe fusion protein as nsp2TF. In PRRSV, LDV and SHFV, nsp2TF is 14-19% shorter than ‘full-length’ nsp2. In all three species, the TF ORF overlaps the part of ORF1a that encodes the predicted TM domain of nsp2 and appears to encode an alternative TM domain containing four or more potential TM regions, depending on species and isolates.

Example 2

Immunodetection of nsp2TF Protein Expression in PRRSV-Infected Cells

In order to confirm that the predicted nsp2TF frameshift product is indeed expressed in virus-infected cells, a polyclonal antibody (pAb-TF) was raised against the C-terminal peptide (CPKGVVTSVGESV (SEQ ID NO: 65)) of the predicted nsp2TF protein of PRRSV isolate SD01-08, a genotype I PRRS virus (Fang et al., 2006). We also used several nsp2-specific monoclonal antibodies (mAbs 36-19 and 58-46), which were previously generated using an antigen containing the N-terminal 436 residues of SD01-08 nsp2 (Fang et al., 2006; Li et al., 2012). Since the predicted nsp2TF would share its 714 N-terminal as (in SD01-08) with nsp2, these mAbs were expected to also recognize nsp2TF.

Expression of nsp2TF was analyzed by immunoprecipitation (IP) and Western blot analysis. MARC-145 cells were infected with PRRSV isolate SD01-08 and cell lysates were harvested at 48 hpi. PRRSV proteins were first immunoprecipitated using mAb36-19 and separated by SDS-PAGE. A similar analysis was performed for isolate SD23983, a genotype II PRRSV, using mAbs (140-68 and 140-43) specific for the nsp2 N-terminal domain of this isolate. The subcellular localization of nsp2TF in virus-infected cells was investigated using immunofluorescence microscopy.

Methods:

Viruses and Cells: BHK-21, RK-13 and MARC-145 cells were cultured in modified Eagle's medium (MEM, Invitrogen, CA) containing 10% fetal bovine serum. Cells were maintained at 37° C. with 5% $CO_2$. The Type I PRRSV isolate (European genotype), SD01-08 (GenBank accession #DQ489311; Fang et al., 2006), and Type II PRRSV isolate (North American genotype), SD23983 (GenBank accession # JX258843) were used in this study. Vaccinia virus recombinant vTF7-3 (Fuerst et al., 1986), which produces the T7 RNA polymerase, was propagated in RK-13 cells.

Antibodies: Monoclonal antibodies mAb36-19, mAb58-46, mAb140-68 and mAb148-43 were produced in our laboratory as described previously (Fang et al., 2006; Li et al., 2012). These antibodies recognize the N-terminal region of both nsp2 and nsp2TF. MAbs 36-19 and 58-46 were produced by immunizing mice with peptide (aa 386-821 in pp1a) of SD01-08, while mAbs 140-68 and 148-43 were produced by immunizing mice with peptide (aa 435-514 in pp1a) of SD23983. A polyclonal antibody, pAb-TF, was produced by GenScript using the synthetic peptide CPKGVVTSVGESV (C-terminal 13 aa of nsp2TF). Rabbits were immunized with the peptide and antibodies were affinity-purified from rabbit immune sera.

Immunoprecipitation and SDS-PAGE: Whole-cell lysates of PRRSV-infected MARC-145 cells were suspended in RIPA buffer [0.5% (w/v) sodium deoxycholate, 1% SDS and 1% (v/w) NP-40 in THE buffer (100 mM NaCl, 1 mM EDTA, pH 8.0, 10 mM Tris-HCl, pH 7.5)]. To reduce the nonspecific background, cell lysates were pre-cleared with rabbit pre-immune sera or mouse ascites, which did not contain PRRSV specific antibodies. Protein A-Sepharose CL-4B beads (Pharmacia Biotech) and an nsp2-specific mAb were added to the pre-cleared cell lysates.

After incubating overnight at 4° C. on a rocker platform, the supernatant was removed and protein A-Sepharose beads/antibody/antigen immune complexes were washed three times with RIP buffer (10 mM Tris-HCl, 150 mM NaCl, 1% NP-40, 0.5% sodium deoxycholate) and three times with deionized $H_2O$. Samples were then boiled in 100 µl of 2× Laemmli sample buffer at 96° C. for 5 min, and proteins were separated by electrophoresis on a 6% SDS-polyacrylamide gel (SDS-PAGE).

Western Blot: Proteins separated by SDS-PAGE were transferred to a nitrocellulose membrane (Protran) by electro-transferring in a Tris-Glycine buffer with 20% methanol for 1 hr. After transferring, the membrane was blocked with PBST (1×PBS in 0.05% Tween 20) and 5% non-fat dry milk at 4° C. overnight. The membrane was then incubated with primary nsp2- and/or nsp2TF-specific antibodies (1:1000 dilution of mAbs and 1:250 dilution of pAb-TF) for 1 hr. at room temperature. After washing with PBST, IRDye 680-conjugated goat anti-rabbit antibody and/or IRDye 800CW-conjugated goat anti-mouse antibody (LI-COR Biosciences, NE) was added and the membrane was incubated for an additional 2 hr. at room temperature. Imaging of the blot was performed under the appropriate excitation wavelength using a digital imaging system (Odyssey infrared imaging system; LI-COR Biosciences, Lincoln, Nebr.).

Immunofluorescence microscopy: For detection of intracellular expression of nsp2 and TF, MARC-145 cells were infected with PRRSV at an MOI of 0.1 in MEM containing 2% horse serum. Cells were fixed with 4% paraformaldehyde in 1×PBS (pH 7.4) at 18 h post-infection. Following permeabilization with 0.1% Triton X-100 and 1% BSA in 1×PBS for 15 min at room temperature, cells were incubated with the primary antibodies of mAb 36-19 (1:1000 dilution) or rabbit anti-sera Prot 00A (1:100 dilution) at 37° C. for 1 hour. After 3× wash with 1×PBS, FITC-conjugated goat anti-mouse antibody (1:100 dilution; ICN Biomedicals), or DyLight 549-labeled goat anti-rabbit IgG (H+L) (1:1000 dilution; KPL) was added as the secondary antibody and incubated at 37° C. for 1 hour. Nuclear staining with DAPI (4',6'-diamino-2-phenylindole 2HCl) was performed as recommended by the manufacturer (Molecular Probes). Cell preparations were imaged using a Zeiss LSM510 confocal fluorescence microscope with a 63× objective. Images were processed with NIH Image/J and Adobe Photoshop 6.0 software.

Figure 3A:
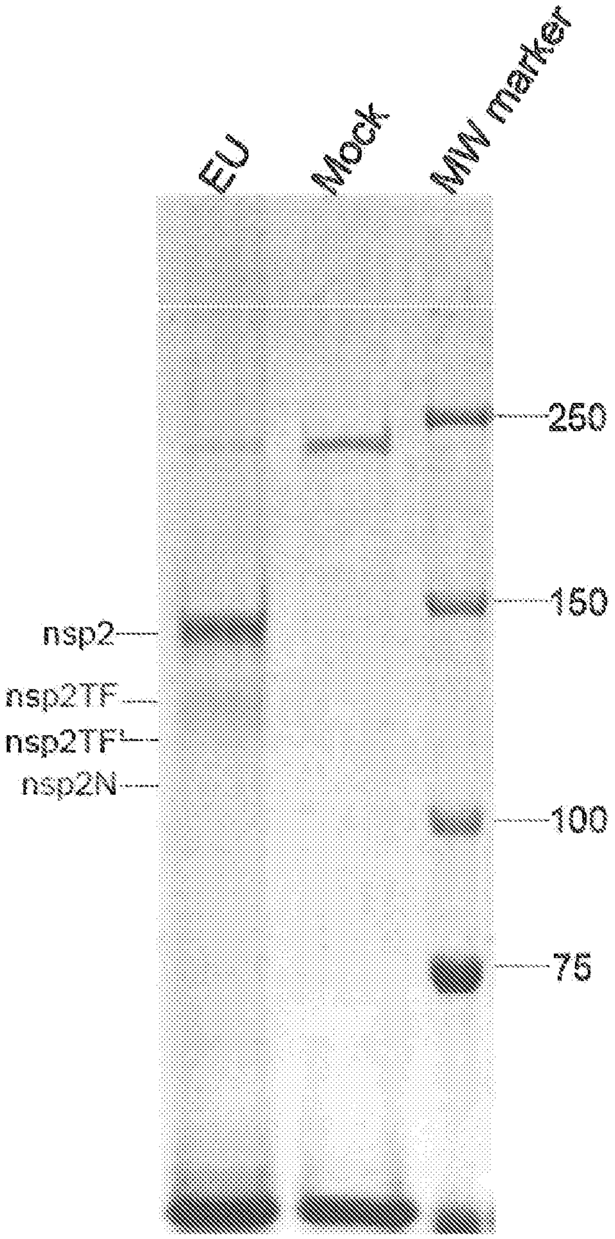
FIG. 3. Immunoprecipitation and Western blot analysis of nsp2TF expression in PRRSV-infected cells. MARC-145 cells were infected with European genotype (EU) PRRSV isolate SD01-08 (Fig. A and B) or North American genotype (NA) PRRSV isolate SD23983 (C). Infected or mock-infected cell lysates were immunoprecipitated (IP) with nsp2-specific mAbs. Immunoprecipitated proteins were separated by SDS-PAGE and stained with Coomassie Blue (A). Expression of specific viral proteins was analyzed by Western blot (WB) (B and C). Each membrane was probed with a specific mAb or pAb as indicated at the bottom of each panel. Positions of the molecular weight marker and (putative) PRRSV proteins are indicated.
Figure 3B:
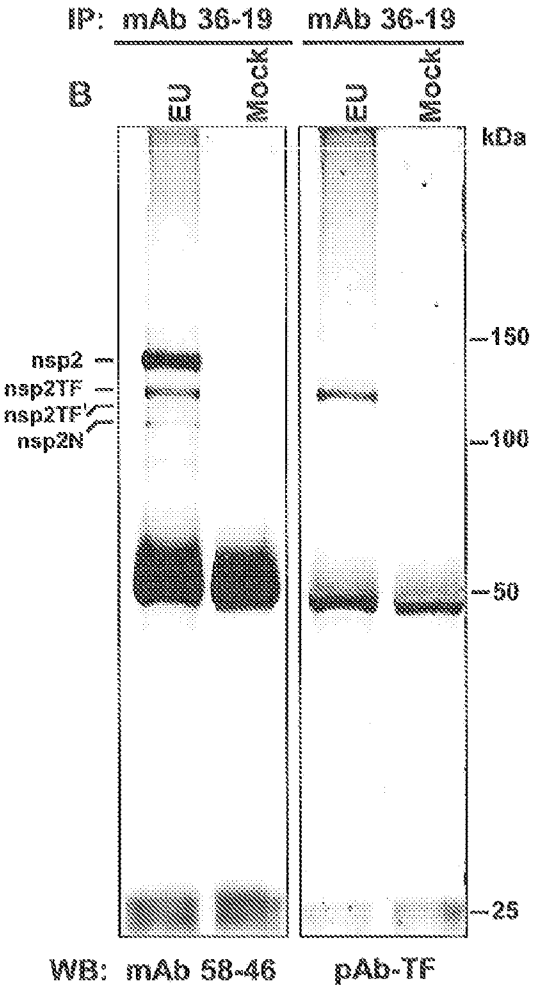

Results:

Four high molecular weight protein bands with apparent sizes between 100-150 kDa were detected by Coomassie Brilliant Blue staining, in which the two smallest products clearly are being less abundant. In addition, various products of lower molecular weight were observed (FIG. 3A).

To confirm that the high-molecular weight bands represent nsp2-related products, a Western blot analysis was performed using mAb58-46, which is specific for the nsp2 N-terminal domain, and the nsp2TF-specific pAb-TF. All four high-molecular weight products were specifically recognized by mAb58-46 (FIG. 3B), indicating that they must share N-terminal sequences, whereas only the second protein (labeled nsp2TF) was recognized by pAb-TF. The third protein (labeled nsp2TF') was not detected in Western blot using pAb-TF. This could be a result of the lower abundance of this protein and/or lower affinity for the antibody, since this product was detected in IP using pAb-TF (see FIG. 7). This protein could be a modified form of nsp2TF. The smallest product of the four (labeled nsp2N) could derive from a −1 frameshift at the same conserved G_GUU_UUU motif Such a frameshift would lead to an immediate termination as there is a −1/+2 frame stop codon adjacent to the shift site (FIG. 6).

Figure 3C:
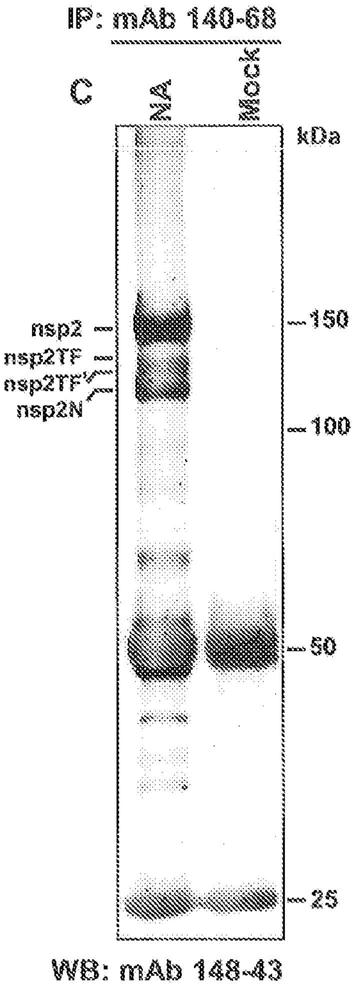

For isolate SD23983, multiple products in the 100-150 kDa size range were detected (FIG. 3C). The available pAb-TF (raised against the SD01-08 TF product) did not cross-react with any of these bands, but this was not surprising since the 13-aa peptide that was used to produce this antibody is not conserved in genotype II viruses.

Figure 4:
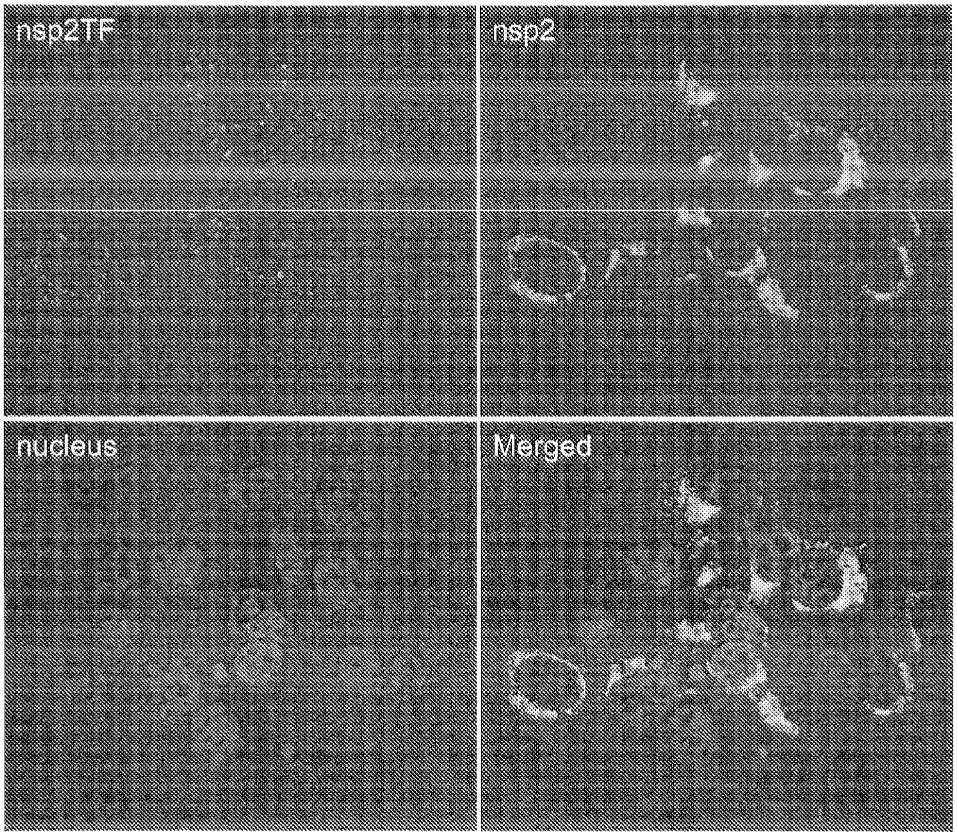
FIG. 4. Detection of nsp2TF protein expression in PRRSV-infected cells by immunofluorescence microscopy, also illustrating that nsp2 and nsp2TF are targeted to different intracellular locations in PRRSV-infected cells. MARC-145 cells were infected with PRRSV SD01-08 and fixed at 18 hpi. Cells were double stained with the nsp2TF-specific rabbit antiserum (A) and a mAb recognizing the PRRSV nsp2 (B). DyLight 549-labeled goat anti-rabbit IgG (A, fluorescence) and FITC-conjugated goat anti-mouse antibody (B, fluorescence) were used as the secondary antibody. The cell nucleus stained with DAPI (C, blue fluorescence). D: merged pictures of A, B and C. Specimens were imaged on a Zeiss LSM510 confocal microscope. A 0.8 μm slice through the nucleus is shown in each image.

The expression of nsp2TF in virus-infected cells was further confirmed using immunofluorescence microscopy. As shown in FIG. 4, the nsp2TF protein was specifically detected by pAb-TF, and distributes as sharp foci around the peri-nuclear region of PRRSV-infected cells. To confirm that pAb-TF was specifically recognizing nsp2TF, cells were double-labeled with the nsp2-specific mAb36-19. The same cluster of virus-infected cells was detected by both antibodies. However, immunofluorescence labeling of infected cells with an nsp2-specific mAb and pAb-TF yielded nonoverlapping labeling patterns, with nsp2 mAbs labeling the familiar arterivirus replication structures and pAb-TF staining an alternative compartment, suggesting that nsp2 and nsp2TF localize to different cellular compartments.

Example 3

Mass Spectrometric Confirmation of nsp2TF Expression

While bioinformatic analysis suggested the site (G_GUU_UUU) and direction (−2) of frameshifting, protein sequence analysis was performed to confirm the predictions. As provided above, PRRSV SD01-08 infected and mock-infected MARC-145 cell lysates were immunoprecipitated with anti-nsp2 mAb36-19, resolved by SDS-PAGE, and stained with Coomassie brilliant blue (FIG. 3A). The gel slice containing the putative nsp2TF band was excised, digested with trypsin, and analyzed by liquid-chromatography-tandem mass spectrometry (LC/MS/MS).

Methods:

Mass Spectrometry: The nsp2TF protein was immunoprecipitated from the virus-infected cell lysate using specific antibodies. After gel electrophoresis, proteins were fixed in isopropanol fixing solution (25% isopropanol/10% acetic acid [v/v]) for 30 min, and then stained with Coomassie brilliant blue G-250 (Bio-Rad; 0.006% [w/v] Coomassie brilliant blue G-250 in 10% acetic acid) for 30 min-1 h. The G-250 stained gel was destained with 10% acetic acid until a clear background with blue protein bands appeared.

The corresponding nsp2TF protein band was excised from the gel, and the gel slice was washed 2× with 50% acetonitrile. The gel slice was then reduced with DTT, alkylated with iodoacetamide and digested with trypsin (Worthington Chemical Corporation) using the Proteineer DP digestion robot (Bruker, Bremen, Germany). The tryptic peptides were extracted from the gel and lyophilized. Peptides were dissolved in 95/3/0.1 v/v/v water/acetonitrile/formic acid and subsequently analyzed by on-line nanoHPLC MS/MS using a 1100 HPLC system (Agilent Technologies), as previously described (Meiring et al, 2002). All columns were packed in house. Peptides were trapped at 10 μl/min on a 15-mm column (100-μm ID; ReproSil-Pur C18-AQ, 3 μm, Dr. Maisch GmbH) and eluted to a 200 mm column (50-μm ID; ReproSil-Pur C18-AQ, 3 μm) at 150 nL/min in a 20 minute gradient from 0 to 30% acetonitrile in 0.1% formic acid. The end of the nanocolumn was drawn to a tip (ID ~5 μm), from which the eluent was sprayed into a 7-tesla LTQ-FT Ultra mass spectrometer (Thermo Electron) operating in data-dependent mode, automatically switching between MS and MS/MS acquisition.

Full scan MS spectra were acquired in the FT-ICR with a resolution of 25,000 at a target value of 3,000,000. The two most intense ions were then isolated for accurate mass measurements by a selected ion monitoring scan in FT-ICR with a resolution of 50,000 at a target accumulation value of 50,000. Selected ions were fragmented in the linear ion trap using collision-induced dissociation at a target value of 10,000. Raw data were converted to peak lists using Bioworks version 3.2. With dta threshold, a Perl script provided with Bioworks, all individual data-files were converted to one Mascot Generic File (MGF). Peptides were identified using Mascot version 2.2.04 (Matrix Science) with the following settings: trypsin as digestion enzyme, carbamidomethyl of cysteine as fixed modification and oxidation of methionine as variable modification, peptide mass tolerance of 2 ppm and MS/MS tolerance of 0.8 Da.

Results:

Four peptides specific for the 170 as TF region were identified, besides many peptides from the N-terminal domain that is shared by nsp2 and nsp2TF. One of the peptides, LMTWVFLK (SEQ ID NO: 67), spanned the frameshift site itself and its sequence is fully compatible with −2 PRF (after decoding GUU_UUU as VF; FIG. 5A-B) but not with +1 PRF, which would produce a shift site peptide that is one amino acid shorter (predicted sequence LMTWVFK (SEQ ID NO:68)).

Figure 5C:
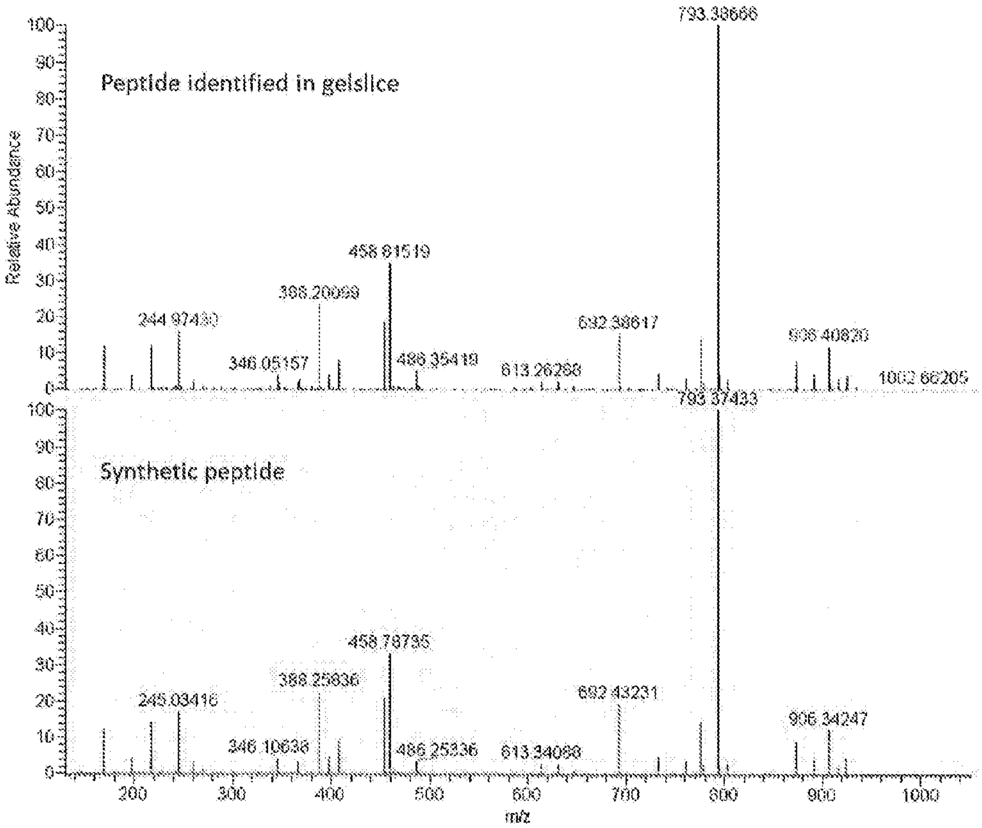
FIG. 5. Mass spectrometric analysis of nsp2TF purified from cells infected with genotype I PRRSV isolate SD01-08.
(FIG. 5A) Nucleotide sequence in the vicinity of the shift site G_GUU_UUU, with conceptual amino acid translations in all three reading frames. The product of −2 frameshifting is indicated in gray (SEQ ID NOs 68, 69). Three tryptic peptides (SEQ ID NOs 70, 71, 72) covering these amino acids were detected by mass spectrometric analysis. The underlined peptide (SEQ ID NO 83), which spans the shift site, is compatible with −2, but not +1, frameshifting. Stylized P- and A-site tRNAs illustrate expected codon: anticodon duplexes before and after frameshifting (see also main text). In eukaryotes, GUU is expected to be decoded by the valine tRNA with anticodon 5'-IAC-3' (I=inosine), but it is possible that it is also decoded by the valine tRNA with anticodon 5'-ncm$^5$UAC-3' (ncm$^5$U=5-carbamoylmethyluridine). The valine anticodon is indicated by 3'-CA*-5' in the schematic.
(FIG. 5B) Complete amino acid sequence of nsp2TF (SEQ ID NO 45). Peptides identified by mass spectrometry are indicated in gray (SEQ ID Nos. 46-60, and 66). The C-terminal 169 aa (SEQ ID NO 61), encoded by the −2 reading frame, are highlighted, while the N-terminal 713 aa (SEQ ID NO 62) are shared with nsp2. (The epitopes recognized by mAbs 36-19, 58-64 and pAb-TF, in order, are underlined. (SEQ ID NOs 63, 64, and 65, respectively). Black underlines indicate the locations of the premature termination codons of mutant KO1 (FIG. 2B.) (FIG. 5C) Tandem mass spectra of the frameshift peptide LMTWVFLK identified from the gel slice (top) and the synthetic peptide (bottom).

To verify the correct identification of the frameshift peptide, a synthetic version of the peptide was produced and subjected to the same LC/MS/MS analysis. The tandem mass spectrum of the synthetic peptide was identical to that of the peptide identified in the gel slice, confirming that nsp2TF is indeed translated via −2 PRF at the G_GUU_UUU motif (FIG. 5C). The analysis was repeated for the PRRSV genotype II isolate SD23983, for which a −2 frameshift tryptic peptide with a different sequence (QVFLTSSPISLFSSHAFSTR (SEQ ID NO: 91)) was predicted. This sequence was identified in mass spectrometric analysis of the presumed nsp2TF band excised from an SDS-PAGE gel (FIG. 6)

Example 4

Estimation of the Frameshifting Efficiency

The frameshifting efficiency and turn-over of nsp2 and nsp2TF were investigated in a pulse-chase labeling experiment. MARC-145 cells were infected with SD01-08 virus. After a 1-h pulse labeling with $^{35}$S-labeled amino acids, the incorporated label was chased for various periods (up to 24 h), and proteins were immunoprecipitated with nsp2- and nsp2TF-specific antibodies.

Methods:

Radioactive labeling and radioimmunoprecipitation (RIP) analysis: To analyze the nsp2TF expression in infected cells, MARC-145 cells were infected with PRRSV SD01-08 at an m.o.i. of 0.1 for 23.5 hr in DMEM containing 2% FCS. Cells were washed with PBS, followed by starvation for 30 min in methionine- and cysteine-free medium (Gibco). Proteins were labeled at 24 hpi with a 1-hour pulse with methionine- and cysteine-free medium containing 500 μCi [$^{35}$S] methionine/cysteine (5:2) mixture (Perkin-Elmer) per ml. Subsequently, cells were washed twice with PBS and incubated for various chase periods (up to 24 hr) in DMEM containing 2 mM (both) unlabeled methionine and cysteine and 2% FCS.

To analyze the ORF1a expression, the plasmid DNA was transiently expressed in RK-13 cells using the recombinant vaccinia virus/T7 polymerase expression system as described previously (Fuerst et al., 1986; Snijder et al., 1994). At 4 hr after transfection, cells were washed with PBS, followed by starvation for 30 min in methionine- and cysteine-free medium. Newly synthesized proteins were labeled with a 30-min pulse using 500 μCi of [$^{35}$S] methionine/cysteine (5:2) mixture per ml. Cells were incubated for various chase periods up to 2 hr. Cells were lysed and RIP analysis was performed as described previously (Li et al., 2012), using the Abs described above. Precipitated proteins were separated by SDS-PAGE. Phosphor imager screens were exposed to the gels and subsequently scanned using a Typhoon Variable Mode Imager (GE Healthcare). Image analysis and quantification of band intensities were performed with the ImageQuant TL software (GE Healthcare).

Results:

As shown in FIG. 7A, this analysis revealed the existence of two smaller products (labeled as nsp2' and nsp2TF') having apparent molecular weights that are about 10 kDa smaller than those of nsp2 and nsp2TF. Its disappearance during the chase suggested nsp2' to be a direct precursor of nsp2, which itself also appeared to be subject to further modification during the chase period, as visualized by its slight size increase and more heterogeneous migration in gel (compare C0h with later time points). The possible precursor status of nsp2TF' was less obvious, since the amount of this product was more or less stable throughout the chase period, during which both the nsp2TF and nsp2TF' bands also appeared to be converted into a doublet. In terms of protein turn-over, the amount of nsp2TF declined much more rapidly than that of nsp2 during the chase period. This was even more pronounced for nsp2N, the putative −1 frameshift product (see above, FIG. 3), which seems to be the least stable of the various nsp2 forms described here. Several smaller nsp2-specific products were observed, including a prominent 95-kDa product in the C0h sample.

To obtain the most accurate assessment of the frameshifting efficiencies, we measured the incorporation into the nsp2+nsp2', nsp2TF+nsp2TF', and nsp2N bands directly after the pulse labeling (lane C0h) and corrected these numbers for the methionine and cysteine content of the different proteins. These measurements suggested −2 and putative −1 frameshifting efficiency of approximately 20% and 8%, respectively. In combination with the different product stabilities observed, these efficiencies appear generally consistent with the Western blot data (FIG. 3), where nsp2TF and nsp2N, and therefore the frameshifting efficiency, appear to be under represented due to the relatively rapid turn-over of these products.

As an alternative system to study the frameshifting event, we employed the transient expression of PRRSV ORF1a in RK-13 cells. A T7 promoter-driven, full-length ORF1a expression vector (pL1a) was constructed and the synthesis of nsp2, nsp2TF, and nsp2N was monitored in the recombinant vaccinia virus/T7 polymerase expression system (Fuerst et al., 1986). Following a 30-min radiolabeling of proteins synthesized in transfected cells, the fate of the various products was monitored for up to 2 h (FIG. 7B), the maximum time allowed in view of vaccinia virus-induced cytopathology. With the exception of nsp2', the products described in FIG. 7A could all be identified, although there were clear differences in abundance, appearance, and stability. For example, note the extreme heterogeneity of nsp2 later in the chase period, the much faster turn-over of nsp2TF', and the almost complete lack of the unidentified nsp2-specific product of 95-kDa. These data clearly demonstrate that translation of the PRRSV ORF1a sequence is sufficient to reproduce the frameshift events observed in infected cells. Still, compared to the experiment in infected MARC-145 cells (FIG. 7A), the use of a different cell line, the lack of PRRSV replication, and the consequences of vaccinia virus infection may each have influenced the frameshifting efficiency and the fate of the various nsp2-related products in this expression system.

Example 5

The Effect of G_GUU_UUU and CCCAxCUCC Motifs on Frameshifting

To investigate whether the CCCANCUCC motif (see above; FIG. 2A) plays a role in stimulation of the frameshift at the G_GUU_UUU site, we engineered two mutants in which the CCCANCUCC motif was disrupted (CC1 and CC2; FIG. 2B).

The CC1 mutations are synonymous in the nsp2 frame, while the CC2 mutations more thoroughly disrupt the motif but include substitutions that are not synonymous with respect to nsp2. As controls, two additional mutants were constructed (SS and IFC; FIG. 2B). The SS mutant contains two mutations in the shift site (G_GUU_UUU mutated to G_GUA_UUC), and is therefore expected to express nsp2 only.

In order to mark the position at which the frameshift product migrates in gels, an in-frame control, IFC, was constructed in which the shift site was synonymously mutated and an extra 2 nt were inserted to force expression of the nsp2TF reading frame (G_GUU_UUU mutated to G_GUG_UUC_UU). This mutant is expected to make only nsp2TF. Mutant pL1a expression constructs were engineered and expressed in the recombinant vaccinia virus/T7 polymerase expression system, along with the wild-type (WT) control.

Methods:

Plasmids for expression of full-length or partial ORF1a: To create the expression plasmid pL1a, the plasmid of EAV pL1a (Snijder et al., 1994) was used. Initially, the EAV ORF1a sequence was replaced by PRRSV ORF1a (aa 1-2379 of PRRSV SD01-08 genome). The construct contains a T7 promoter and a copy of the encephalomyocarditis virus internal ribosomal entry site upstream of the PRRSV sequence. The T7 terminator sequence was inserted downstream of the PRRSV sequence. PRRSV ORF1a was modified to facilitate cloning and site-directed mutagenesis. A set of translational silent mutations, $C_{1878}$ to G, $A_{4449}$ to T and $C_{6000}$ to G, were introduced to inactivate the internal NcoI restriction enzyme sites. An NcoI restriction site (CCATGG), containing a translational initiation codon, was engineered upstream of the sequence encoding PRRSV ORF1a-specific residues.

Using the PRRSV pL1a backbone, the N- or C-terminus truncates of ORF1a (Table 1) were constructed by RT-PCR amplification of corresponding regions with primer pairs flanking NcoI and NotI restriction enzyme sites at the 5' and 3' ends. The PCR product was digested with NcoI and NotI restriction enzymes and ligated into the pL1a plasmid that was digested with the same restriction enzymes.

Site-directed mutagenesis: Each individual point mutation was introduced into the nsp2 region of the expression vector pL1a or a PRRSV full-length cDNA clone plasmid pSD01-08 (Fang et al., 2006). Except KO2 and nsp1βcc-2 mutants, generated by synthetic genes, all the mutations were introduced by site-directed mutagenesis. Briefly, a shuttle plasmid pTOPO-ES was generated by cloning the genomic sequences (nt 3365 to 6990 of SD01-08 genome) into pCR®-Blunt II-TOPO® Vector (Invitrogen). Specific mutations were then introduced into the pTOPO-ES by the Quick-Change site-directed PCR mutagenesis kit (Stratagene). After verification by DNA sequencing, the fragments carrying the specific mutations were digested by restriction enzymes EcoRV and SgrAI and ligated into the pSD01-08 or pL1a plasmid backbone, which was digested with the same restriction enzymes.

Transient protein expression and radioimmunoprecipitation (RIP) analysis: The plasmid DNA was transiently expressed in RK-13 cells using the recombinant vaccinia virus/T7 polymerase expression system (Fuerst et al., 1986). Proteins synthesized in transfected cells were labeled from 5 to 8 h after vaccinia virus infection, using methionine-free medium and 100 μCi of [$^{35}$S]-methionine/ml. Cells were lysed and RIP analysis was performed as described previously (Snijder et al., 1994). RIP was performed using rabbit antiserum specific to TF protein or antibodies recognizing both nsp2 and TF protein. The precipitated proteins were separated by SDS-PAGE. Phosphor imager screens were exposed to the gels and subsequently scanned using a Typhoon Variable Mode Imager (GE Healthcare). Image analysis and quantification of band intensities were performed with the ImageQuant TL software (GE Healthcare).

Results:

As shown in FIG. 7C, WT pL1a produced both nsp2 and nsp2TF, and expression of the latter protein was confirmed by IP with pAb-TF. As expected, the IFC mutant produced only nsp2TF, as detected by both pAb-TF and mAb58-46. The CC1 and CC2 mutants, in which the CCCANCUCC motif is disrupted, produced nsp2 but no nsp2TF was detected. Interestingly, the shift site mutant SS still allowed a small (but greatly reduced) amount of −2 frameshifting. These results indicate that both the G_GUU_UUU shift site and the downstream CCCANCUCC motif are required for ribosomal frameshifting at the WT efficiency.

Example 6

Nsp1β Expression is Required for Efficient Frameshifting

The sequences required for the −2 PRF were further investigated. A panel of truncated ORF1a expression constructs with a T7 promoter was generated (Table 1), and the expression of nsp2 and nsp2TF was tested in the recombinant vaccinia virus/T7 polymerase expression system (Fuerst et al., 1986). Following radiolabeling of proteins synthesized in transfected cells, the expression of nsp2TF and nsp2 were analyzed by radioimmunoprecipitation (RIP) using pAb-TF (recognizes nsp2TF) or mAb58-64 and pAb-nsp2-3 (recognize both nsp2 and nsp2TF). To further determine whether the frameshift stimulation involves the nsp1β protein or an underlying RNA sequence, we tested whether the frameshift could be induced by nsp1β expression in trans.

Methods:

Plasmids for Expression of Full-Length or Partial ORF1a:

Using the PRRSV pL1a backbone, the 5'- or 3'-terminal truncations of ORF1a (Table 1) were constructed by RT-PCR amplification of corresponding regions with primer pairs flanking NcoI and NotI restriction enzyme sites at their 5' and 3' ends. The PCR product was digested with NcoI and NotI restriction enzymes and ligated into the pL1a plasmid that had been digested with the same restriction enzymes. The plasmid pLnsp1βcc-2 was constructed by mutating nearly every codon in the nsp1β-coding region synonymously (FIG. 9A), while keeping the encoded nsp1β amino acid sequence fully intact. The modified nsp1β-coding sequence (nsp1βcc) was synthesized as a synthetic gene and fused back with the nsp2-coding region to generate construct pLnsp1βcc-2.

Transient Protein Expression and Radioimmunoprecipitation (RIP) Analysis:

The plasmid DNA was transiently expressed in RK-13 cells using the recombinant vaccinia virus/T7 polymerase expression system (Fuerst et al., 1986). Proteins synthesized in transfected cells were labeled from 5 to 8 h after vaccinia virus infection, using methionine-free medium and 100 μCi of [$^{35}$S]-methionine/ml. Cells were lysed and RIP analysis was performed as described previously (Snijder et al., 1994). RIP was performed using pAb-TF specific to the nsp2TF protein or mAbs recognizing both nsp2 and nsp2TF. The precipitated proteins were separated by SDS-PAGE. Phosphor imager screens were exposed to the gels and subsequently scanned using a Typhoon Variable Mode Imager (GE Healthcare). Image analysis and quantification of band intensities were performed with the ImageQuant TL software (GE Healthcare).

Figure 8B:
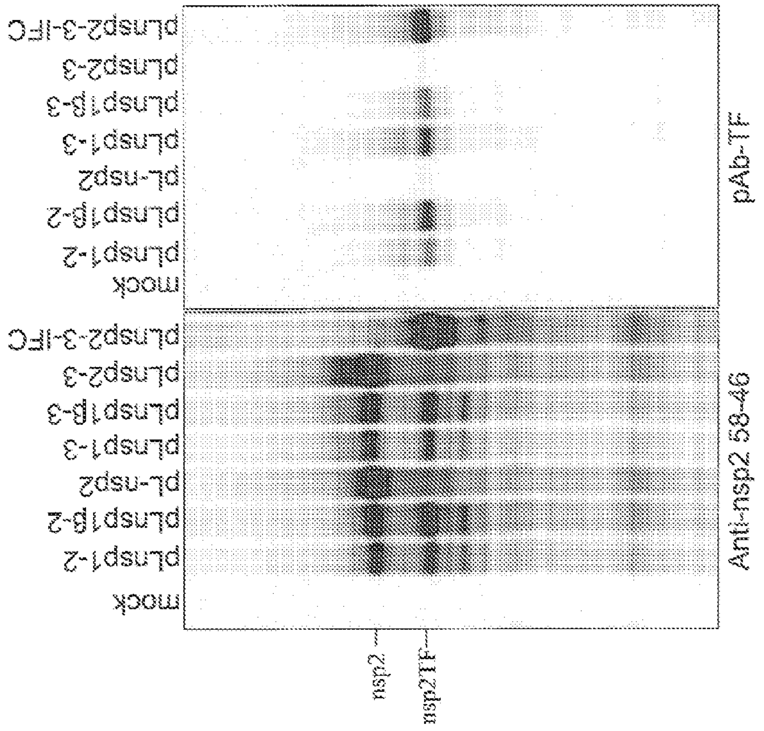
Figure 8A:

Results:

As shown in FIG. 8A, both nsp2 and nsp2TF were detected in lysates from cells transfected with the full-length ORF1a construct, but nsp2TF was barely detected in lysates from cells transfected with constructs pLnsp2-8 and pLnsp2-3, suggesting that an element required for PRF resides within the nsp1-coding region of ORF1a. Another set of constructs expressing nsp1-3 proteins with truncations at the N- or C-terminus was generated. RIP results showed that constructs lacking the nsp1α- and/or nsp3-coding region continued to express the same amount of nsp2TF as pL1a. In contrast, those constructs lacking the nsp1β-coding region produced nsp2 but no significant amount of nsp2TF was detected (FIG. 8B). This indicates that nsp1β or the nsp1β-encoding RNA sequence is required for efficient ribosomal frameshifting at the G_GUU_UUU motif in the nsp2-coding region, about 2.5 kb downstream.

Figures 9B, 9C:
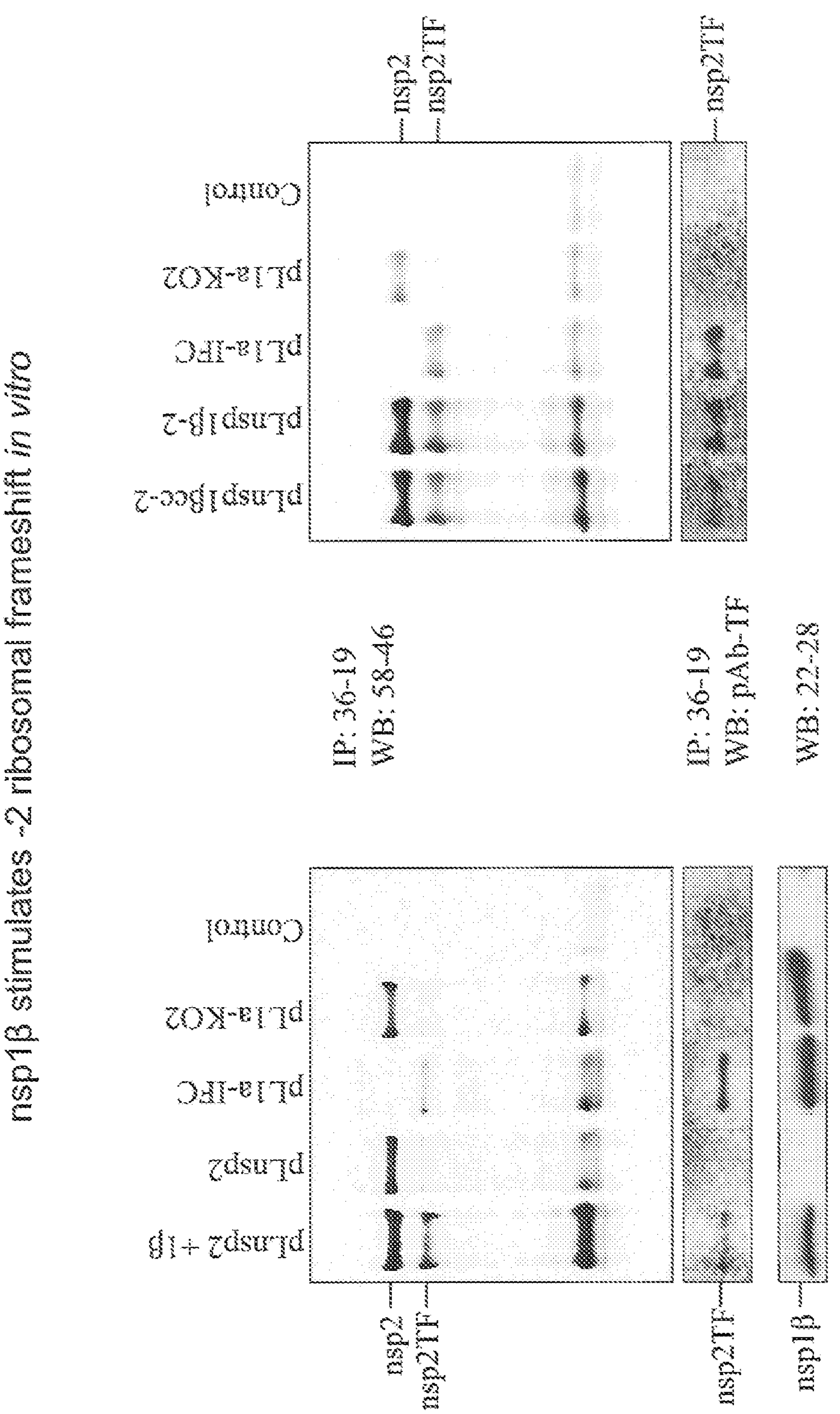

As shown in FIG. 9B, nsp2TF was also detected in cells co-transfected with separate plasmids expressing nsp2 (pLnsp2) and nsp1β (pLnsp1β). This indicates that nsp1β-stimulation of nsp2TF expression can operate in trans. To test whether this effect was mediated by the nsp1β protein rather than the nsp1β-coding RNA sequence, a drastically altered nsp1β-coding sequence, with nearly every codon mutated synonymously (but avoiding rare codons), was synthesized and fused back with the nsp2-coding sequence to generate the construct pLnsp1βcc-2, which expresses an unchanged nsp1β protein sequence whereas the underlying nsp1β-coding RNA sequence was dramatically altered (FIG. 9A), to an extent that is expected to disrupt any functionally important primary or secondary RNA structure elements that might be involved in −2 PRF. Expression of pLnsp1βcc-2 was tested in the vaccinia virus/T7 polymerase expression system. For comparison, the WT construct pLnsp1β-2 and the in-frame control pL1a-IFC (which only expresses nsp1-nsp2TF; see below) were included in the analysis. Western blot analysis showed that nsp2TF was efficiently expressed in cells transfected with pLnsp1βcc-2 (FIG. 9C), which strongly suggests that the frameshift stimulation involves the nsp1β protein but not the underlying RNA sequence.

TABLE I

List of Constructs

| Construct | TF Expression | Notes | SEQ ID NO |
|---|---|---|---|
| pL1a | Yes | Expression of WT ORF1a in vaccinia/T7 system | SEQ ID NO 1 |
| pLnsp2-8 | No | Expression of nsp2 to nsp8 in vaccinia/T7 system | SEQ ID NO 3 |
| pLnsp1-2 | Yes | Expression of nsp1α to nsp2 in vaccinia/T7 system | SEQ ID NO 4 |
| pLnsp1β-2 | Yes | Expression of nsp1β to nsp2 in vaccinia/T7 system | SEQ ID NO 5 |
| pLnsp1βcc-2 | Yes | Expression of synthetic nsp1β to nsp2 in vaccinia/T7 system; Every codon of nsp1β synonymously mutated | SEQ ID NO 6 |
| pLnsp2 | No | Expression of nsp2 in vaccinia/T7 system | SEQ ID NO 9 |
| pLnsp1-3 | Yes | Expression of nsp1α to nsp3 in vaccinia/T7 system | SEQ ID NO 10 |
| pLnsp1β-3 | Yes | Expression of nsp1β to nsp3 in vaccinia/T7 system | SEQ ID NO 11 |
| pLnsp2-3 | No | Expression of nsp2 to nsp3 in vaccinia/T7 system | SEQ ID NO 12 |
| pLnsp2-3-IFC | Yes | In-frame control; Express nsp2TF only in vaccinia/T7 system | SEQ ID NO 13 |
| pLnsp1β | No | Expression of nsp1β in vaccinia/T7 system | SEQ ID NO 15 |
| pL1a-IFC | Yes | In-frame control; Express nsp2TF only in vaccinia/T7 system | SEQ ID NO 16 |

TABLE I-continued

| List of Constructs | | | |
|---|---|---|---|
| Construct | TF Expression | Notes | SEQ ID NO |
| pL1a-KO1 | No | TF knock out mutant 1; premature termination codons in TF; generated smaller size of TF in vaccinia/T7 system | SEQ ID NO 17 |
| pL1a-KO2 | No | TF knock out mutant 2; premature termination codon and disrupted frameshift cassette. | SEQ ID NO 19 |
| pL1a-SS | No | Frameshift site mutant; Express nsp2 only in vaccinia/T7 system | SEQ ID NO 21 |
| pL1a-CC1 | No | disrupted CCCAxCUCC motif; Express nsp2 only in vaccinia/T7 system | SEQ ID NO 23 |
| pL1a-CC2 | No | disrupted CCCAxCUCC motif; Express nsp2 only in vaccinia/T7 system | SEQ ID NO 25 |
| pSD01-08-IFC | Yes | In-frame control; No viable virus generated | SEQ ID NO 27 |
| pSD01 08-KO1 | No | TF knock out mutant 1; viable virus generated | SEQ ID NO 31 |
| pSD01 08-KO2 | No | TF knock out mutant 2; viable virus generated | SEQ ID NO 32 |

Example 7

Figure 10A:
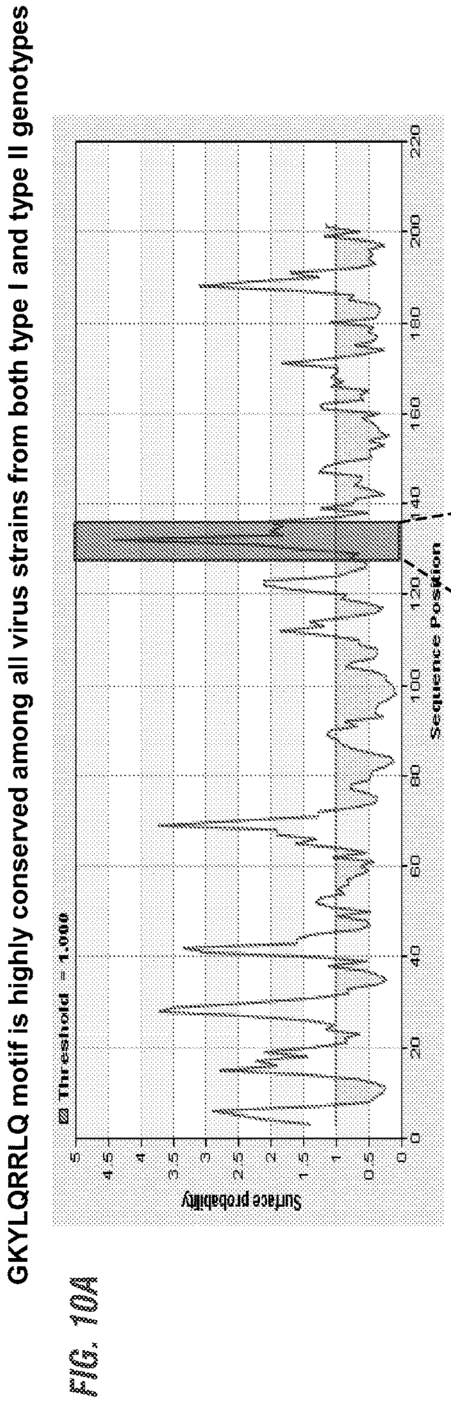

A Highly Conserved GKYLQRRLQ Motif in Nsp1β is Critical for its Function as a Trans-Activator of −2 PRF We further mapped a potential domain in nsp1β that is critical for its trans-activator function. A panel of site-specific nsp1β mutants was constructed (Table 2). They were designed based on the protein surface accessibility prediction (Emini et al., 1985), hydrophilicity analysis (Hopp & Woods, 1981) and crystal structure of nsp1β (Xue et al., 2010). The conserved hydrophilic amino acids predicted to be exposed on the protein surface were targeted for mutagenesis (FIG. 10A). The various nsp1β-2 mutants carrying a double-mutation (Table 2) were initially examined using the vaccinia/T7 polymerase expression system. Potential RNA-binding residues in GKYLQRRLQ motif (SEQ ID NO: 149) were predicted based on bioinformatics analysis.

TABLE 2

| Construct | Mutation | WT codon | Mutant codon | Virus strain |
|---|---|---|---|---|
| E41A/E43A | E-41→A | GAG | GCG | Type 1 |
| | E-43→A | GAA | GCA | |
| E68A/E71A | E-68→A | GAG | GCG | Type 1 |
| | E-71→A | GAG | GCG | |
| K130A/R134A | K-130→A | AAG | GCG | Type 1 |
| | R-134→A | CGC | GCC | |
| K124A/R128A | K-124→A | AAG | GCG | Type 2 |
| | R-128→A | CGG | GCG | |
| C96S | C-96→A | TGC | AGC | Type 1 |

Methods:

The nsp1β-2-coding region from type 1 PRRSV (763-4559 nt of SD01-08 genome) and type 2 PRRSV (731-4927 nt of SD95-21 genome) were RT-PCR amplified from genomic RNA of PRRSV SD01-08 (EU) and SD95-21 (NA), respectively. The PCR product of the nsp1β-2 region was cloned into the pL1a plasmid (Snijder et al., 1994), designated as pL-EU-nsp1β-2 and pL-NA-nsp1β-2. Specific mutations were introduced by site-directed mutagenesis using the QuickChange™ site-directed mutagenesis kit (Stratagene) following the manufacturer's instructions. The plasmid DNA was transiently expressed in RK-13 cells using the recombinant vaccinia virus/T7 polymerase expression system (Fuerst et al., 1986). Proteins synthesized in transfected cells were detected by immunoprecipitation and Western blot analysis.

The K130A and R134A mutations that interfere with nsp2TF expression were introduced into the nsp1β region of p3×FLAG-nsp1β using the QuickChange™ site-directed mutagenesis kit (Stratagene). Potential RNA-binding residues in nsp1β were searched using BindN program world wide web at bioinfo.ggc.org/bindn.

Results:

As shown in FIG. 11, WT nsp1β-2 (Type 1 PRRSV) produced nsp2, nsp2TF and nsp2N. The E41A/E43A and E68A/E71A mutations did not affect the expression of these nsp2-related proteins. In contrast, nsp2TF and nsp2N were not detected in cells expressing the K130A/R134A mutant. The K130 and R134 residues in nsp1β of Type 1 PRRSV correspond to K124 and R128 in nsp1β of Type 2 PRRSV. We repeated our experiment using nsp1β-2 from a Type 2 PRRSV strain, SD95-21. The result was consistent with that obtained with Type 1 virus. The expression of WT nsp1β-2 generated the corresponding frameshift products, while no nsp2TF and a reduced level of nsp2N were detected in cells expressing the K124A/R128A mutant.

Figure 10B:
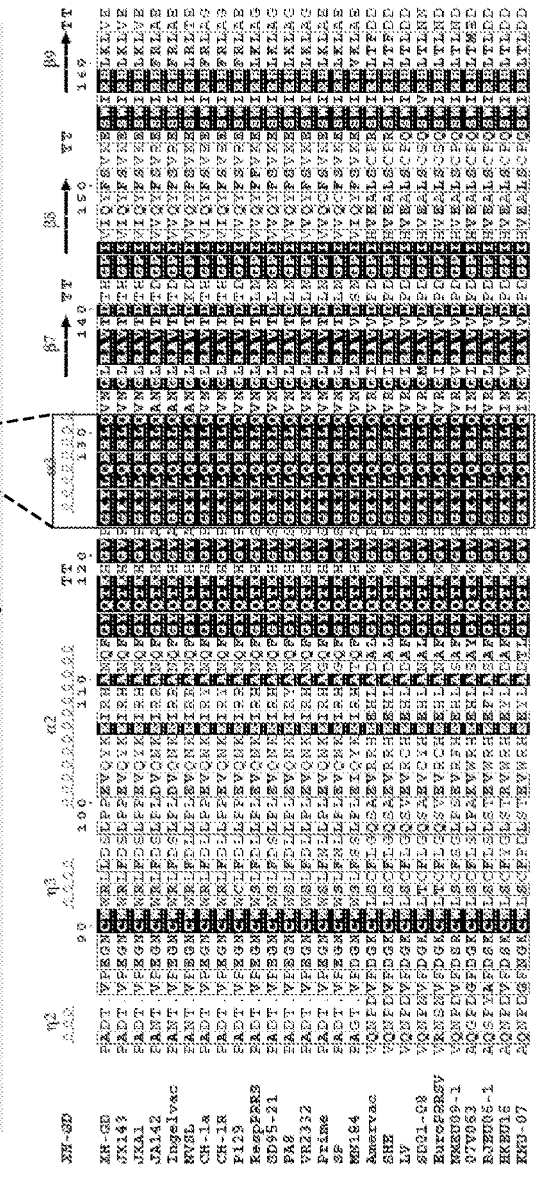

Based on the published crystal structure of nsp1β from a Type 2 PRRSV (Xue et al., 2010), the K124 and R128 residues are likely exposed on the protein surface (FIG. 12). We further searched for potential functional motifs in this region and the result showed that these two resides are located on the motif, GKYLQRRLQ (Kolaskar & Tongaonkar, 1990), which as the highest hydrophilicity value in comparison to other regions of nsp1β (FIG. 10A). Amino acid sequence alignment of nsp1β sequences from 212 PRRSV isolates available in GenBank revealed that the GKYLQRRLQ motif is highly conserved among all available PRRSV stains, including both Type 1 and Type 2 viruses (FIG. 10B). More interestingly, amino acid sequence alignment of nsp1β among different species of arteriviruses indicated that the GKYLQRRLQ motif is also highly conserved in LDV and SHFV (FIG. 13). Its conservation in three out of four distantly related arteriviruses suggests an important role for the GKYLQRRLQ motif in nsp1β's function(s). (Note that the fourth arterivirus, EAV, does not express nsp2TF.) Next, we used the BindN program to predict RNA-binding residues in nsp1β. The result showed that the GKYLQRRLQ motif contains five (Type 1 virus) or four (Type 2 virus) predicted RNA-binding residues (FIG. 12).

Example 8

Effect of Inactivation of nsp2TF Expression on PRRSV Replication in Cell Culture To investigate whether nsp2TF expression and/or the diversion of a proportion of ribosomes out of ORF1a are relevant for virus replication, three mutants were constructed to partially or completely knock out nsp2TF expression (KO1, KO2 and KO3; FIGS. 2B and 2C). The KO1 mutant makes a truncated nsp2TF protein due to the insertion of two stop codons into the 170-codon TF ORF at codons 101 and 103. Consequently, the truncated nsp2TF lacks the C-terminal pAb-TF epitope. The KO2 mutant contains 9 mutations that disrupt the frameshift site and the downstream CCCANCUCC motif, besides introducing a stop codon into the TF ORF. This mutant is intended to completely knock out the frameshift signal and is expected to express only nsp2. KO1 and KO2 differ from WT virus by 2 and 9 nucleotide substitutions, respectively, none of which affect the nsp2 amino acid sequence. KO3 contains the nsp1β mutations K130A/R134A (Type 1 PRRSV) or K124A/R128A (Type 2 PRRSV).

These mutants from Type 1 PRRSV were first tested in the ORF1a expression system to verify the synthesis of the expected proteins. Subsequently, these mutations were further introduced into the full-length cDNA clones of both Type 1 (SD01-08) and Type 2 (SD95-21) virus.

Methods:

Site-Directed Mutagenesis:

Each individual point mutation was introduced into the Type 1 PRRSV nsp2 region of the expression vector pL1a, or PRRSV full-length cDNA clone plasmid pCMV-SD01-08 (type 1 PRRSV, Fang et al., 2006) and pCMV-SD95-21 (type 2 PRRSV, GenBank KC469618). Except KO2, which was generated by gene synthesis, all the mutations were introduced by site-directed mutagenesis. Briefly, a shuttle plasmid pTOPO-ES was generated by cloning the genomic sequences into pCR®-Blunt II-TOPO® Vector (Invitrogen). Specific mutations were then introduced into the pTOPO-ES by the Quick-Change site-directed PCR mutagenesis kit (Stratagene). After verification by DNA sequencing, the fragments carrying the specific mutations were digested by restriction enzymes and ligated into the corresponding plasmid backbone, which was digested with the same restriction enzymes.

Rescue of Recombinant Viruses:

The plasmid carrying a full-length PRRSV cDNA or its mutant was used to transfect BHK-21 cells, using FuGENE HD reagent (Roche, CA) and following the manufacturer's instruction. To rescue the virus, cell culture supernatant obtained at 24 to 48 h post-transfection was passaged on MARC-145 cells. The rescue of infectious virus was confirmed by IFA at 48-72 h post infection. To monitor the stability of the mutations introduced into the TF/nsp2 region, recombinant viruses were serially passaged 20 times on MARC-145 cells. RNA was extracted from cells infected with passage 20 of the recombinant virus using a QiaAmp viral RNA kit (Qiagen, MD). The genomic region containing the mutations was amplified by RT-PCR and sequenced at the Iowa State University DNA sequencing facility (Ames, Iowa).

Growth Kinetics and Plaque Assay:

Growth kinetics was examined by infecting MARC-145 cells with passage 2 of WT virus, KO1, KO2 or KO3 mutant at an MOI of 0.1. Supernatants from infected cells were collected at 12, 24, 36, 48, 60, and 72 h post infection (hpi), and virus titers were determined by the fluorescent focus assay as described previously (Sun et al., 2012). Virus titers were expressed as number of fluorescent focus units per ml (FFU/ml). Plaque morphologies of mutants and parental virus were compared by a plaque assay. Confluent cell monolayers in 6-well plates were infected with 10-fold serial dilutions of parental or mutant virus. At 2 h post infection, medium was removed and a 2% agar (SeaPlaque Agrose, Lonza, Rockland, Me.) overlay was applied. After 4 days of incubation at 37° C., cells were stained with 0.1% crystal violet.

Results:

The mutants of Type 1 PRRSV were first tested in the ORF1a expression system to verify the synthesis of the expected proteins. Indeed, the frameshift product of mutant KO1, which contains the premature stop codons in the TF ORF, could not be detected using pAb-TF, which is explained by the truncation of the C-terminal epitope region. However, IP with mAb58-64 revealed the synthesis of a truncated form of nsp2TF and nsp2TF' (FIG. 7C, arrows) and a similar ratio between full-length nsp2 and the frameshift product. On the other hand, the mutations introduced in KO2 were found to eliminate frameshifting, while at the same time a much larger amount of full-length nsp2 was produced (FIG. 7C). As showed in FIG. 11 (Example 8), the K130A/R134A (Type 1 virus) or K124A/R128A (Type 2 virus) introduced into the nsp1β region also eliminated the frameshifting.

The KO1, KO2 and KO3 mutations were subsequently transferred to PRRSV full-length cDNA infectious clones of both genotypes to determine whether viable recombinant viruses could be obtained. As shown in FIG. 14, a panel of viable recombinant viruses was generated, although all the mutants produced plaques that were clearly smaller than those of the WT virus. Growth kinetic analysis consistently showed that replication of all mutants was impaired in MARC-145 cells, with peak titers of these mutants being 50- to 100-fold lower than those of the WT virus.

Example 9

Effects of Inactivation of nsp2TF Expression on the De-Ubiquitination and deISGylation Ability of PRRSV As shown in FIG. 4, in PRRSV-infected cells, nsp2TF was found to be targeted to a different subcellular location in comparison to full-length nsp2, possibly the exocytic pathway rather than the modified ER membranes where nsp2 is located and with which viral RNA synthesis is associated. The result suggests that nsp2 and nsp2TF may have different functions in viral replication and/or immune evasion. The nsp2 and nsp2TF proteins share a common N-terminal PLP2 domain. When the PLP2 domain was individually expressed in transfected cells, PLP2 was determined to possess de-ubiquitination (de-Ub) and de-ISGylation functions that involve in antagonizing cellular innate immune responses (Sun et al., 2010, 2012; van Kasteren et al., 2012, 2013). We performed ubiquitination and ISGylation assays to compare the de-Ub and de-ISGylation ability of KO1, KO2 and KO3 recombinant viruses with that of WT virus.

Methods:

ISG15 Conjugation (ISGylation) Assay:

MARC-145 cells were infected with PRRSV SD-95-21 WT or nsp2TF knock out mutants, KO1, KO2, or KO3. At 24 h post-infection, cells were stimulated with IFN-α. The cell monolayer was lysed in Laemmli sample buffer for Western blot analysis at 12 h post-stimulation. For the detection of ISG15 expression, the nitrocellulose membrane was probed with mAb F-9 or rabbit polyclonal antibody H-150 (both from Santa Cruz Biotechnology, Santa Cruz, Calif.). The mAb M2 (Sigma, St. Louis, Mo.) was used to detect the expression of Flag-tagged proteins.

Ubiquitination Assay:

BHK-21 cells was transfected with 0.5 μg of pcDNA3.1-HA-Ub expressing HA-tagged ubiquitin and 2 μg of pCMV-SD95-21 containing the full-length cDNA clone of type 2 PRRSV SD-95-21. Transfection was conducted using FuGENE HD reagent (Roche) following the manufacturer's instructions. At 24 h post-transfection, cells were harvested for Western blot analysis. The mAb HA-7 (Sigma, St. Louis, Mo.) was used to detect the expression of HA-tagged proteins. The expression of PRRSV nsp1β was detected by mAb22-28 as described previously (Li et al., 2012), and mAb H3 (Lambda Biotech, St. Louis, Mo.) was used to detect β-tubulin expression.

Figure 15A:
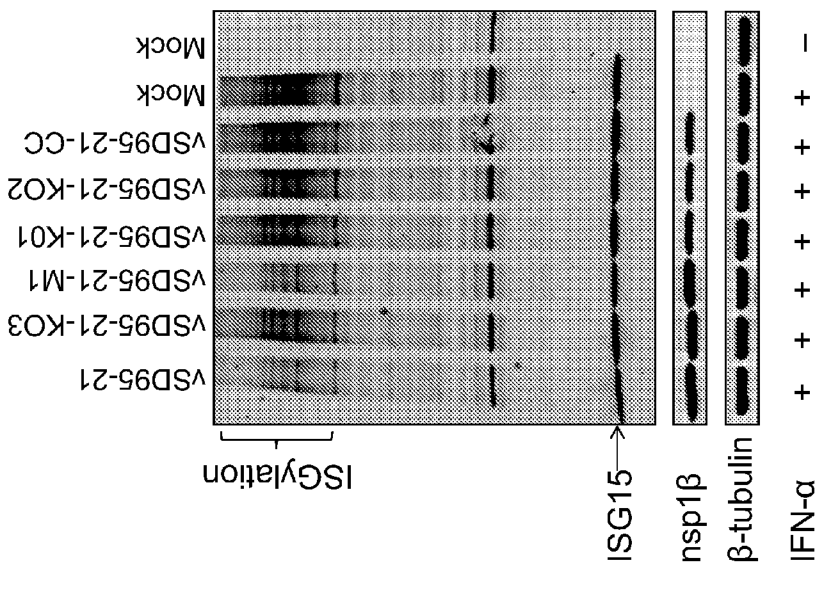
Figure 15B:
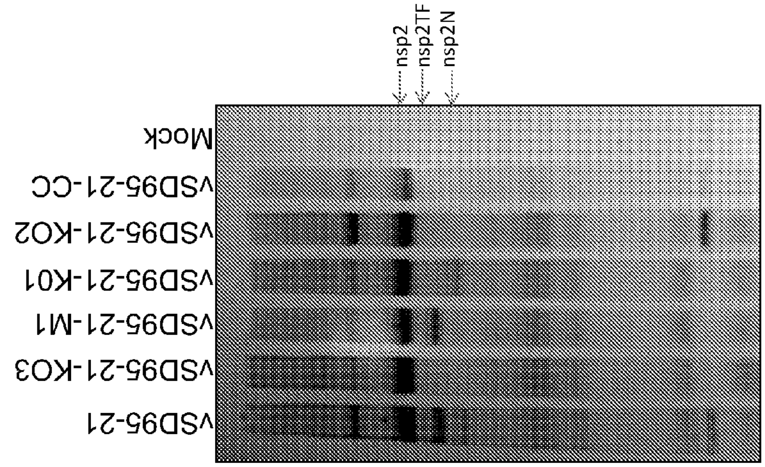

Results:

The result of the ISGylation assay is shown in FIG. 15. A clear decrease in the level of ISGylated proteins was observed in cells infected with WT virus, indicating that the WT virus has the ability to counteract the ISGylation of cellular proteins (FIG. 15A). In contrast, all three mutants, KO1, KO2 and KO3, had almost lost their ability to interfere with ISGylation, even though the knock out of nsp2TF expression did not affect the expression level of nsp2 (FIG. 15B). Next, we tested the de-Ub ability of these nsp2TF knock-out mutants. BHK-21 cells were co-transfected with a plasmid expressing HA-tagged ubiquitin and the plasmid containing full-length cDNA of WT PRRSV or its mutants. The empty plasmid vector was used as a control. As shown in FIG. 16, the WT PRRSV resulted in decreased expression levels of ubiquitin-conjugated proteins, while the nsp2TF knock out mutants displayed an impaired ability to interfere with cellular protein ubiquitination. Taken together, these data suggest that nsp2TF is important for interfering with cellular protein ISGylation and ubiquitination processes.

Example 10

In Vivo Characterization of nsp2TF Knock Out Mutants in a Pig Challenge Model Two recombinant viruses, vSD95-21-KO1 and vSD95-21-KO2 were tested in a nursery pig model. Protection induced by nsp2TF-deficient mutants was assessed by challenging the pigs with the homologous virus, SD95-21. The experimental design is presented in Table 3. The degree of protective immunity was assessed based on the measurement of lung lesion scores, and determination of the level of viremia, virus-neutralizing antibodies, innate and cellular immune cytokine response.

TABLE 3

Design of animal study (*dpi: days post-immunization)

| Group* | Vaccine construct (0 dpv) | Challenge virus (28 dpv) | Collection of blood samples (dpv) |
|---|---|---|---|
| 1 (n = 5) | Mock | Mock | 0, 7, 14, 21, 28, 31, 35, 41 |
| 2 (n = 8) | Mock | SD 95-21 | 0, 7, 14, 21, 28, 31, 35, 41 |
| 3 (n = 8) | Wild-type | SD 95-21 | 0, 7, 14, 21, 28, 31, 35, 41 |
| 4 (n = 8) | KO1 | SD 95-21 | 0, 7, 14, 21, 28, 31, 35, 41 |
| 5 (n = 8) | KO2 | SD 95-21 | 0, 7, 14, 21, 28, 31, 35, 41 |

*Three pigs from group2-5 pigs were euthanized at 10 dpv to assess the gross pathology during the acute infection.

Methods:

Animals/Challenge Groups:

Animals and challenge groups were assigned as shown in Table 3. Mutant or WT viruses (2 ml, $1\times10^6$ FFU/ml) were used to immunize pigs. Cell culture medium was used as a negative control. At 10 days post-vaccination (dpv), three pigs per group were euthanized for assessment of gross pathology following acute infection. The rest of the pigs (n=5) were challenged with SD95-21 virus (2 ml, $1\times10^7$ FFU/ml) at 28 dpv, and pigs were euthanized at 41 dpv. Blood samples were collected regularly (Table 3). Gross lung lesions were evaluated during the necropsy.

Quantification of Viral Load:

For the detection of viral RNA and determination of viral load, serum and tissue samples were examined using PCR and virus titration.

Determine Humoral, Innate and Cell-Mediated Immunity:

To determine the innate and cell-mediated immunity induced by vaccine candidates, PBMCs were isolated and stimulated with killed challenge viral antigens, PHA (positive control), or cell culture medium (negative control). PBMC culture supernatant and serum samples were analyzed for innate and cellular immune responses using swine cytokine FMIA as described in our previous publications (Invitrogen; Lawson et al., 2010, 2012). Humoral antibody response was evaluated using the IDEXX HerdChek® PRRS 3XR ELISA and virus-neutralizing assay as we described previously (Fang et al., 2006, 2008; Lawson et al., 2012).

Nsp2TF Knock Out Mutants were Attenuated in Pigs

Figure 17B:
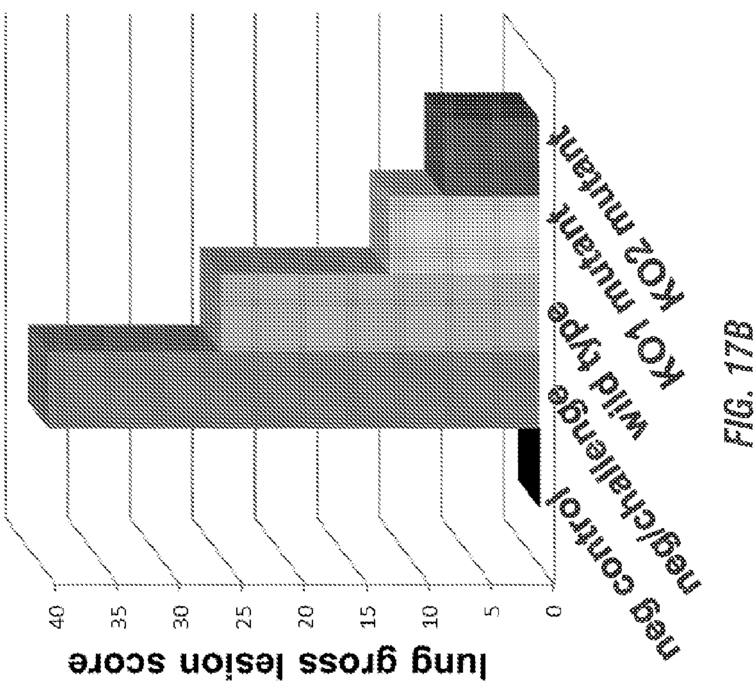
Figure 17A:
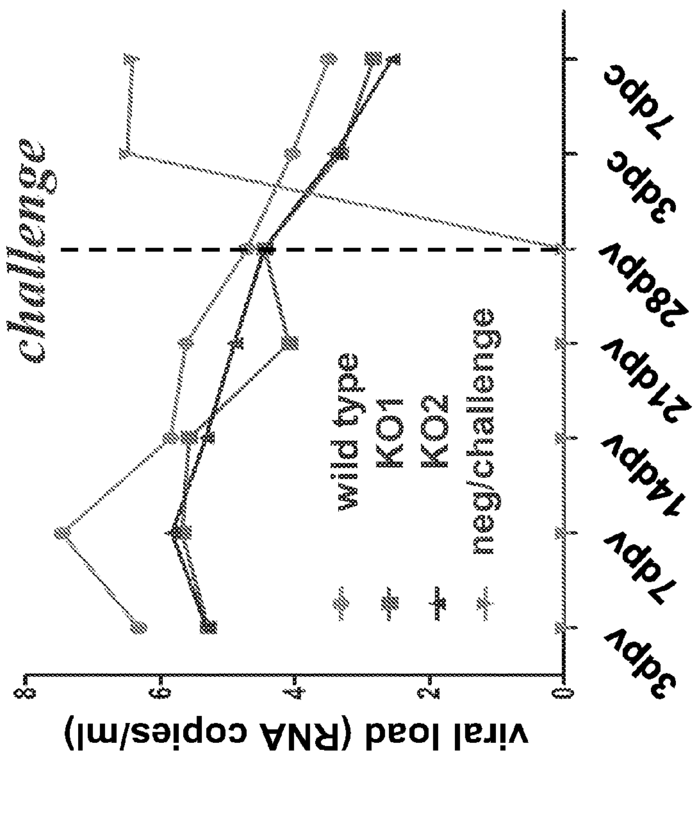

To determine whether these nsp2 epitope deletion mutants replicated in vivo, serum samples collected at 7-28 dpv were used for virus isolation on MARC-145 cells. Viruses were recovered from the serum samples of pigs from groups 3-5 collected at 3, 7 and 14 dpv, indicating active replication of mutant viruses in pigs. The amount of viraemia was further quantified by real-time qRT-PCR (FIG. 17A). All twonsp2TF knock out mutants infected pigs had significant lower viral load than those pigs infected with wild-type virus at 7 dpv. At 3, 14 and 28 dpv, although the mean values of viral load are not significant different due to the large variation of individual pigs, the average viral loads were consistently lower in all of the mutant-infected pigs compared with pigs infected with wild-type virus. To access the lung pathology during the acute infection, three pigs from each of the group 2-5 were euthanized at 10 dpv. Gross lung lesions were absent in mutant virus-infected pigs, and mild lesions (2-6%) were observed in wild-type virus infected pigs.

Nsp2TF Knock Out Mutants Induced Protection in Pigs Against PRRSV Challenge

To investigate whether these nsp2TF mutants are capable to induce protection against PRRSV challenge, group 2-5 pigs were challenged with parental virus, SD95-21 at 28 dpv.

In comparison to group 2 control pigs, viral loads were significantly decreased in pigs vaccinated with WT or nsp2TF knock out mutants at 3 and 7 day post challenge (dpc), while viral load in pigs infected with KO1 or KO2 mutant was about 10-fold lower than that of WT-infected pigs (FIG. 17A). At necropsy (13 dpc), lung pathology was evaluated. In group 2 pigs (negative control pigs challenged with WT virus), visible gross lung lesions were significant and affected 36-63% of the lung surfaces. In contrast, group 3-5 pigs had reduced gross lung lesions. There was about 3- or 4-fold decrease of gross lung lesion in KO1- or KO2-vaccinated pigs in comparison to that of WT-vaccinated pigs (FIG. 17B). As expected, no significant lung lesions were observed in negative control group 1 pigs.

Since nsp2TF contains a PLP2 domain that is known to be involved in antagonizing innate immune responses, we further determined whether altered nsp2TF expression had effect on the host immune responses that might contribute to the level of protection as we observed in FIG. 17. Initially, we monitored the temporal expression of selected innate and cellular immune genes in peripheral blood mononuclear cells (PBMCs) from whole blood of control or virus-infected pigs at 3, 7, 14, 21, 28, 30, 35 and 41 dpv. Swine cytokine FMIA was performed to measure the protein expression level of targeted cytokines, including immune markers for innate immunity: IL-1β, IL-8, IFN-α, TNF-α, IL-12; Th1 immunity: IFN-γ; Th2 immunity: IL-4; and regulatory T cell response: IL-10. The FMIA result showed weak re-stimulation responses as expected for PBMCs. However, at 7 days post vaccination, PBMCs from KO1 and KO2 mutants-infected pigs produced a different cytokine expression pattern compared with that from WT virus-infected pigs, with notable increased levels of IFN-α and IL-8 expression (FIG. 18).

Figure 19A:
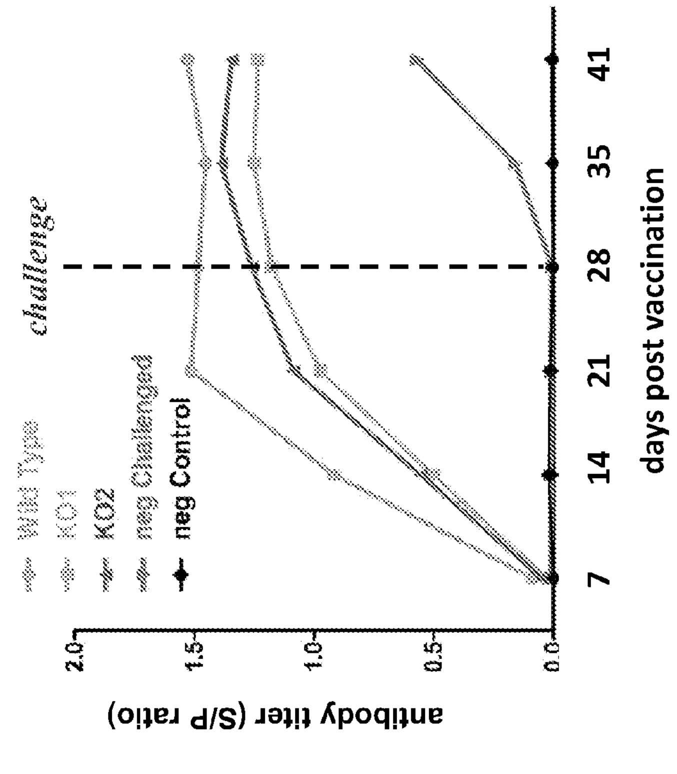
Figure 19B:
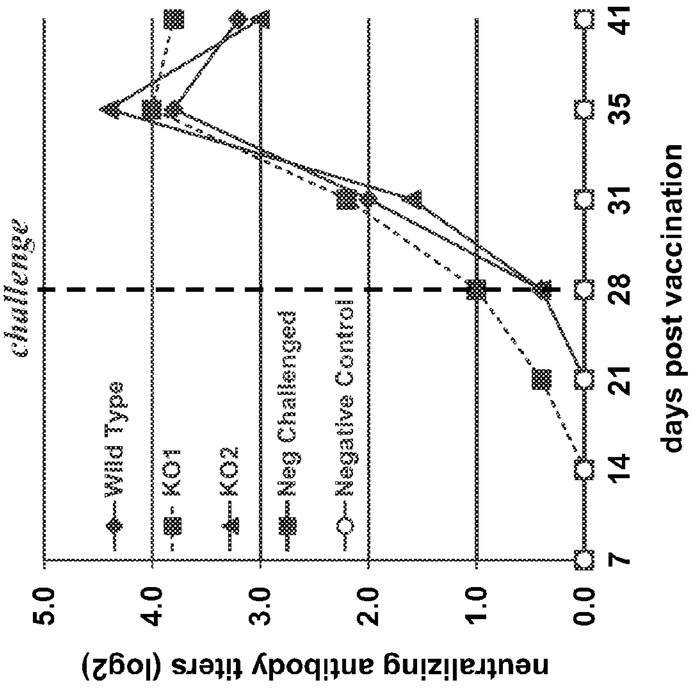

Humoral immune response was also evaluated. By 14 dpv, all pigs in the WT, KO1 and KO2 groups had seroconverted as measured by IDEXX ELISA (FIG. 19A). The result correlates well with the level of viral load in these groups of pigs. Further measurement of the virus neutralizing (VN) antibody levels showed that a VN antibody response was first detected at 21 dpv in a KO1 mutant-infected pig. At 28 dpv, two pigs in KO1 group and one pig in each of the KO2 and WT group developed a detectable VN response. After challenge (35dpv), all vaccinated pigs developed VN response, and the mean VN titer for the KO2 mutant-infected group of pigs was higher than those of other groups. At 41 dpv, the mean VN titer for the KO1 mutant-infected group of pigs was the highest among different pig groups. However, the difference between groups was not statistically significant due to large variation among individual pigs and the limited number of pigs in each group (FIG. 19B).

Example 11

Truncation of the nsp2TF Protein without Altering the Amino Acid Sequence of the Overlapping Nsp2 Protein Because of the degeneracy of the genetic code, it is possible to introduce stop codons into the C-terminal portion of the nsp2TF protein without changing the amino acid sequence of the nsp2 protein. Such truncated versions of nsp2TF may have biological properties that differ from those of the full-length natural nsp2TF protein, and therefore be useful in the design of vaccines and diagnostics.

The following is a non-exhaustive list of single nucleotide mutations in the portion of the nsp2TF coding region downstream from the −2 frameshift site, which create stop codons in nsp2TF without altering the amino acid sequence of the overlapping nsp2 reading frame. The reference PRRS strain in this example is the North American (type 2) strain P129-PKC12-FL passage 52, which can be found as SEQ ID NO: 6 in PCT application WO 2012/063212 A1. Nucleotide numbers cited below correspond to positions in the 15,450 nt genomic sequence of this virus. These mutations cause premature termination (C-terminal truncation) of the nsp2TF protein without altering the length or amino acid sequence of the nsp2 protein. Mutations of this type may be used alone. They may also be used in combinations or two or more to ensure complete truncation and to greatly reduce the probability of reversion to full-length nsp2TF protein due to back-mutations during viral replication.

1. Changing nt 3878 from C to A creates a TAG stop codon in nsp2TF (ACCTCGTCT to ACCTAGTCT)
2. Changing nt 4022 from G to A creates a TAG stop codon in nsp2TF (TCTTGGGTG to TCTTAGGTG)
3. Changing nt 4079 from G to A creates a TAG stop codon in nsp2TF (GGCTGGCTT to GGCTAGCTT)
4. Changing nt 4091 from T to A creates a TAG stop codon in nsp2TF (CTGTTGGCC to CTGTAGGCC)
5. Changing nt 4121 from C to A creates a TAG stop codon in nsp2TF (CAGTCGGCA to CAGTAGGCA)
6. Changing nt 4184 from C to G creates a TGA stop codon in nsp2TF (TTCTCAAAC to TTCTGAAAC)
7. Changing nt 4211 from T to A creates a TAG stop codon in nsp2TF (GCCTTGTTG to GCCTAGTTG)
8. Changing nt 4214 from T to A creates a TAG stop codon in nsp2TF (TTGTTGTGG to TTGTAGTGG)
9. Changing nt 4217 from G to A creates a TAG stop codon in nsp2TF (TTGTGGGCC to TTGTAGGCC)
10. Changing nt 4226 from C to A creates a TAG stop codon in nsp2TF (CCGTCGGTC to CCGTAGGTC)
11. Changing nt 4232 from C to A creates a TAG stop codon in nsp2TF (GTCTCGGTC to GTCTAGGTC)
12. Changing nt 4238 from T to A creates a TAG stop codon in nsp2TF (GTCTTGCCA to GTCTAGCCA)
13. Changing nt 4247 from T to A creates a TAG stop codon in nsp2TF (TTCTTGGCA to TTCTAGGCA)
14. Changing nt 4259 from G to A creates a TAG stop codon in nsp2TF (TACTGGGCG to TACTAGGCG)
15. Changing nt 4292 from T to G creates a TGA stop codon in nsp2TF (TGCTTAGGC to TGCTGAGGC)
16. Changing nt 4298 from T to A creates a TAG stop codon in nsp2TF (GGCTTGGCA to GGCTAGGCA)
17. Changing nt 4304 from T to A creates a TAG stop codon in nsp2TF (GCATTGTTG to GCATAGTTG)
18. Changing nt 4307 from T to A creates a TAG stop codon in nsp2TF (TTGTTGCAG to TTGTAGCAG)
19. Changing nt 4322 from G to A creates a TAG stop codon in nsp2TF (TCTTGGCTG to TCTTAGCTG)

Reducing the efficiency of the −2 frameshifting event in nsp2 can be accomplished in strain P129-PKC12-FL passage 52 by mutating the conserved GGUUUUU motif at the frameshift site or the conserved CCCANCUCC motif downstream of the frameshift site as described in Example 5. The sequences of these motifs in strain P129-PKC12-FL passage 52 are the same as shown in FIG. 2A for North American PRRS strains SD23983 and SD95-21 (GGUUUUU and CCCAUCUCC, respectively). Likewise, −2 frameshifting in nsp2 can be inhibited in strain P129-PKC12-FL passage 52 by mutating the conserved GKYLQRRLQ motif in nsp1β, as described in Example 8 and shown In FIG. 11. This amino acid sequence is completely conserved in strain P129-PKC12-FL passage 52.

Example 12

Truncation of the nsp2TF Protein without Altering the Amino Acid Sequence of the Overlapping Nsp2 Protein in an Attenuated Chinese Highly Pathogenic PRRS Virus Because of the degeneracy of the genetic code, it is possible to introduce stop codons into the C-terminal portion of the nsp2TF protein without changing the amino acid sequence of the nsp2 protein. Such truncated versions of nsp2TF may have biological properties that differ from those of the full-length natural nsp2TF protein, and therefore be useful in the design of vaccines and diagnostics.

The following is a non-exhaustive list of single nucleotide mutations in the portion of the nsp2TF coding region downstream from the −2 frameshift site, which create stop codons in nsp2TF without altering the amino acid sequence of the overlapping nsp2 reading frame. The reference PRRS strain in this example is the Chinese "Highly-Pathogenic" (genotype 2) strain TJM-F92 (passage 92), which can be found as SEQ ID NO: 1 in United States patent application US 2012/0189655. Nucleotide numbers cited below correspond to positions in the 14,966 nt genomic sequence of this virus. These mutations cause premature termination (C-terminal truncation) of the nsp2TF protein without altering the length or amino acid sequence of the nsp2 protein. Mutations of this type may be used alone. They may also be used in combinations or two or more to ensure complete truncation and to greatly reduce the probability of reversion to full-length nsp2TF protein due to back-mutations during viral replication.

20. Changing nt 3444 from C to A creates a TAG stop codon in nsp2TF (GCCTCGTTT to GCCTAGTTT)
21. Changing nt 3619 from C to A creates a TGA stop codon in nsp2TF (TGTGCGAAT to TGTGAGAAT)
22. Changing nt 3645 from G to A creates a TAG stop codon in nsp2TF (GGTTGGCTT to GGTTAGCTT)
23. Changing nt 3657 from T to A creates a TAG stop codon in nsp2TF (CTGTTGGTC to CTGTAGGTC)
24. Changing nt 3687 from C to A creates a TAG stop codon in nsp2TF (CAGTCGGCA to CAGTAGGCA)
25. Changing nt 3750 from C to A creates a TAA stop codon in nsp2TF (TTCTCAAAC to TTCTAAAAC)
26. Changing nt 3777 from T to A creates a TAG stop codon in nsp2TF (GCCTTGTTG to GCCTAGTTG)
27. Changing nt 3780 from T to A creates a TAG stop codon in nsp2TF (TTGTTGTGG to TTGTAGTGG)
28. Changing nt 3783 from G to A creates a TAG stop codon in nsp2TF (TTGTGGGCC to TTGTAGGCC)
29. Changing nt 3792 from C to A creates a TAG stop codon in nsp2TF (CCGTCGGTC to CCGTAGGTC)
30. Changing nt 3798 from C to A creates a TAG stop codon in nsp2TF (GTCTCGGCC to GTCTAGGCC)
31. Changing nt 3804 from T to A creates a TAG stop codon in nsp2TF (GCCTTGCCA to GCCTAGCCA)
32. Changing nt 3813 from T to A creates a TAG stop codon in nsp2TF (TTCTTGGCA to TTCTAGGCA)
33. Changing nt 3825 from G to A creates a TAG stop codon in nsp2TF (TACTGGGCG to TACTAGGCG)
34. Changing nt 3858 from T to A creates a TAA stop codon in nsp2TF (TGCTTAGGC to TGCTAAGGC)
35. Changing nt 3864 from T to A creates a TAG stop codon in nsp2TF (GGCTTGGCA to GGCTAGGCA)
36. Changing nt 3870 from T to A creates a TAG stop codon in nsp2TF (GCATTGTTG to GCATAGTTG)
37. Changing nt 3873 from T to A creates a TAG stop codon in nsp2TF (TTGTTGCAG to TTGTAGCAG)
38. Changing nt 3888 from G to A creates a TAG stop codon in nsp2TF (TCTTGGCTG to TCTTAGCTG)

Reducing the efficiency of the −2 frameshifting event in nsp2 can be accomplished in strain TJM-F92 (passage 92) by mutating the conserved GGUUUUU motif at the frameshift site or the conserved CCCANCUCC motif downstream of the frameshift site as described in Example 5. The sequences of these motifs in strain TJM-F92 (passage 92) are the same as shown in FIG. 2A for North American PRRS strains SD23983 and SD95-21 (GGUUUUU and CCCAUCUCC, respectively). Likewise, −2 frameshifting in nsp2 can be inhibited in strain TJM-F92 (passage 92) by mutating the conserved GKYLQRRLQ motif in nsp1β, as described in Example 8 and shown In FIG. 11. This amino acid sequence is completely conserved in strain TJM-F92 (passage 92).

REFERENCES

1. Ahlquist P (2006) Parallels among positive-strand RNA viruses, reverse-transcribing viruses and double-stranded RNA viruses. *Nat Rev Microbiol* 4(5):371-382.
2. Brierley I, Gilbert R J C, & Pennell S (2010) Pseudoknot-Dependent Programmed-1 Ribosomal Frameshifting: Structures, Mechanisms and Models. Recoding: expansion of decoding rules enriches gene expression: 149-174.
3. Brierley I, Jenner A J, & Inglis S C (1992) Mutational analysis of the "slippery-sequence" component of a coronavirus ribosomal frameshifting signal. *J Mol Biol* 227 (2):463-479.
4. Brown E, et al. (2009) Antibody response to porcine reproductive and respiratory syndrome virus (PRRSV) nonstructural proteins and implications for diagnostic detection and differentiation of PRRSV types I and II. (Translated from eng) *Clin Vaccine Immunol* 16(5):628-635.
5. Cavanagh D (1997) Nidovirales: a new order comprising Coronaviridae and Arteriviridae. *Arch Virol* 142(3):629-633.
6. Chen Z, et al. (2010) Immunodominant epitopes in nsp2 of porcine reproductive and respiratory syndrome virus are dispensable for replication, but play an important role in modulation of the host immune response. *J Gen Virol* 91(Pt 4):1047-1057.
7. Chung B Y, Firth A E, & Atkins J F (2010) Frameshifting in alphaviruses: a diversity of 3' stimulatory structures. *J Mol Biol* 397(2):448-456.
8. Conzelmann K K, Visser N, Van Woensel P, & Thiel H J (1993) Molecular characterization of porcine reproductive and respiratory syndrome virus, a member of the arterivirus group. *Virology* 193(1):329-339.
9. de Groot R J., Cowley J A, Enjuanes L, Faaberg, K S, Perlman S, Rottier P J, Snijder E J, Ziebuhr J, Gorbalenya A E. 2012. Order Nidovirales, p. 785-795. In A. King, M. Adams, E. Carstens, and E. J. Lefkowitz (eds.), Virus Taxonomy, the 9th Report of the International Committee on Taxonomy of Viruses. Academic Press.
10. de Lima M, et al. (2008) Development of a porcine reproductive and respiratory syndrome virus differentiable (DIVA) strain through deletion of specific immunodominant epitopes. *Vaccine* 26(29-30):3594-3600.

11. Demeshkina N, Jenner L, Westhof E, Yusupov M, Yusupova G (2012) A new understanding of the decoding principle on the ribosome. *Nature* doi10.1038/nature10913 [Epub ahead of print] PMID: 22437501.
12. den Boon J A, et al. (1991) Equine arteritis virus is not a togavirus but belongs to the coronaviruslike superfamily. *J Virol* 65(6):2910-2920.
13. Dinman J D, Icho T, & Wickner R B (1991) A −1 ribosomal frameshift in a double-stranded RNA virus of yeast forms a gag-pol fusion protein. *Proc Natl Acad Sci USA* 88(1):174-178.
14. Du Z, Fenn S, Tjhen R, & James T L (2008) Structure of a construct of a human poly(C)-binding protein containing the first and second K H domains reveals insights into its regulatory mechanisms. *J Biol Chem* 283(42): 28757-28766.
15. Fang Y, et al. (2008) Development of genetic markers in the non-structural protein 2 region of a US type 1 porcine reproductive and respiratory syndrome virus: implications for future recombinant marker vaccine development. *J Gen Virol* 89(Pt 12):3086-3096.
16. Fang Y, et al. (2004) Heterogeneity in Nsp2 of European-like porcine reproductive and respiratory syndrome viruses isolated in the United States. *Virus Res* 100(2): 229-235.
17. Fang Y, et al. (2006) A full-length cDNA infectious clone of North American type 1 porcine reproductive and respiratory syndrome virus: expression of green fluorescent protein in the Nsp2 region. *J Virol* 80(23):11447-11455.
18. Fang Y & Snijder E J (2010) The PRRSV replicase: exploring the multifunctionality of an intriguing set of nonstructural proteins. *Virus Res* 154(1-2):61-76.
19. Farabaugh P J (2010) Programmed Frameshifting in Budding Yeast. Recoding: expansion of decoding rules enriches gene expression: 221-247.
20. Firth A E, Blitvich B J, Wills N M, Miller C L, & Atkins J F (2010) Evidence for ribosomal frameshifting and a novel overlapping gene in the genomes of insect-specific flaviviruses. *Virology* 399(1):153-166.
21. Firth A E, Wills N M, Gesteland R F, & Atkins J F (2011) Stimulation of stop codon read through: frequent presence of an extended 3' RNA structural element. *Nucleic Acids Res* 39(15):6679-6691.
22. Firth A E, Brierley I (2012) Non-canonical translation in RNA viruses. *J Gen Virol* (in press).
23. Fuerst T R, Niles E G, Studier F W, & Moss B (1986) Eukaryotic transient-expression system based on recombinant vaccinia virus that synthesizes bacteriophage T7 RNA polymerase. *Proc Natl Acad Sci USA* 83(21):8122-8126.
24. Goodman R P, et al. (2011) Clinical isolates of *Trichomonas vaginalis* concurrently infected by strains of up to four Trichomonasvirus species (Family Totiviridae). *J Virol* 85(9):4258-4270.
25. Gorbalenya A E, Enjuanes L, Ziebuhr J, & Snijder E J (2006) Nidovirales: evolving the largest RNA virus genome. *Virus Res* 117(1):17-37.
26. Guarraia C, Norris L, Raman A, & Farabaugh P J (2007) Saturation mutagenesis of a +1 programmed frameshift-inducing mRNA sequence derived from a yeast retrotransposon. *RNA* 13(11): 1940-1947.
27. Han J, Rutherford M S, & Faaberg K S (2010) Proteolytic products of the porcine reproductive and respiratory syndrome virus nsp2 replicase protein. *J Virol* 84(19):10102-10112.
28. Hopp T P, Woods K R (1983): A computer program for predicting protein antigenic determinants. *Mol Immunol* 20(4):483-489.
29. Ivanov I P & Atkins J F (2007) Ribosomal frameshifting in decoding antizyme mRNAs from yeast and protists to humans: close to 300 cases reveal remarkable diversity despite underlying conservation. *Nucleic Acids Res* 35(6): 1842-1858.
30. Jacks T, Townsley K, Varmus H E, & Majors J (1987) Two efficient ribosomal frameshifting events are required for synthesis of mouse mammary tumor virus gag-related polyproteins. *Proc Natl Acad Sci USA* 84(12):4298-4302.
31. Jackson R J, Hellen C U, & Pestova T V (2010) The mechanism of eukaryotic translation initiation and principles of its regulation. *Nat Rev Mol Cell Biol* 11(2):113-127.
32. Johnson C R, Yu W, & Murtaugh M P (2007) Cross-reactive antibody responses to nsp1 and nsp2 of Porcine reproductive and respiratory syndrome virus. *J Gen Virol* 88(Pt 4):1184-1195.
33. Kim D Y, et al. (2009) Insertion and deletion in a non-essential region of the nonstructural protein 2 (nsp2) of porcine reproductive and respiratory syndrome (PRRS) virus: effects on virulence and immunogenicity. *Virus Genes* 38(1):118-128.
34. Kollmus H, Hentze M W, & Hauser H (1996) Regulated ribosomal frameshifting by an RNA-protein interaction. *RNA* 2(4):316-323.
35. Larkin M A, et al. (2007) Clustal W and Clustal X version 2.0. *Bioinformatics* 23(21):2947-2948.
36. Larsen J E, Lund O, Nielsen M (2006): Improved method for predicting linear B-cell epitopes. *Immunome Res* 2:2.
37. Lauck M, et al. (2011) Novel, divergent simian hemorrhagic fever viruses in a wild Ugandan red colobus monkey discovered using direct pyrosequencing. *PLoS One* 6(4):e19056.
38. Li Y, Tas A, Snijder E J, & Fang Y (2012) Identification of Porcine Reproductive and Respiratory Syndrome Virus ORF1a-Encoded Nonstructural Proteins in Virus-Infected Cells. *J Gen Virol*. In press.
39. Liu H W, Chu Y D, & Tai J H (1998) Characterization of *Trichomonas vaginalis* virus proteins in the pathogenic protozoan *T. vaginalis*. *Arch Virol* 143(5):963-970.
40. Loughran G, Firth A E, & Atkins J F (2011) Ribosomal frameshifting into an overlapping gene in the 2B-encoding region of the cardiovirus genome. *Proc Natl Acad Sci USA* 108(46):E1111-1119.
41. Loughran G, Firth A E, & Atkins J F (2011) Ribosomal frameshifting into an overlapping gene in the 2B-encoding region of the cardiovirus genome. *Proc Natl Acad Sci USA* 108(46):E1111-1119.
42. Lu J, et al. (2011) A 5'-proximal stem-loop structure of 5' untranslated region of porcine reproductive and respiratory syndrome virus genome is key for virus replication. *Virol J* 8:172.
43. Masters P S. 2006. The molecular biology of coronaviruses. *Adv Virus Res.* 66:193-292.
44. Matsufuji S, Matsufuji T, Wills N M, Gesteland R F, & Atkins J F (1996) Reading two bases twice: mammalian antizyme frameshifting in yeast. *EMBO J* 15(6):1360-1370.
45. Meiring H, Van der Heeft E, Ten Hove G, & De Jong A (2002) Nanoscale LC-MS (n): technical design and applications to peptide and protein analysis. *Journal of separation science* 25(9):557-568.

46. Melian E B, et al. (2010) NS1' of flaviviruses in the Japanese encephalitis virus serogroup is a product of ribosomal frameshifting and plays a role in viral neuro-invasiveness. *J Virol* 84(3):1641-1647.
47. Meulenberg J J M, et al. (1993) Lelystad virus, the causative agent of porcine epidemic abortion and respiratory syndrome (PEARS), is related to LDV and EAV. *Virology* 192(1):62-72.
48. Miller W A & Giedroc D P (2010) Ribosomal frameshifting in decoding plant viral RNAs. Recoding: expansion of decoding rules enriches gene expression: 193-220.
49. Moore R, Dixon M, Smith R, Peters G, & Dickson C (1987) Complete nucleotide sequence of a milk-transmitted mouse mammary tumor virus: two frameshift suppression events are required for translation of gag and pol. *J Virol* 61(2):480-490.
50. Ogle J M, et al. (2001) Recognition of cognate transfer RNA by the 30S ribosomal subunit. *Science* 292(5518): 897-902.
51. Oleksiewicz M, Bøtner A, Toft P, Normann P, & Storgaard T (2001) Epitope mapping porcine reproductive and respiratory syndrome virus by phage display: the nsp2 fragment of the replicase polyprotein contains a cluster of B-cell epitopes. *Journal of Virology* 75(7):3277-3290.
52. Perlman S, Netland J. 2009. Coronaviruses post-SARS: update on replication and pathogenesis. *Nat Rev Microbiol.* 2009 June; 7(6):439-50.
53. Rice P, Longden I, & Bleasby A (2000) EMBOSS: the European Molecular Biology Open Software Suite. Trends Genet 16(6):276-277.
54. Snijder E J & Meulenberg J J M (1998) The molecular biology of arteriviruses. *Journal of general virology* 79(5):961-980.
55. Snijder E J, Spaan W J M. 2007. Arteriviruses, p. 1337-1355. In D. M. Knipe and P. M. Howley (eds.), Fields Virology. Lippincott, Williams & Wilkins, Philadelphia, Pa.
56. Snijder E J, Wassenaar A, & Spaan W (1994) Proteolytic processing of the replicase ORF1a protein of equine arteritis virus. *Journal of virology* 68(9):5755-5764.
57. Snijder E J, Wassenaar A L M, Spaan W J M, & Gorbalenya A E (1995) The Arterivirus Nsp2 Protease. *Journal of Biological Chemistry* 270(28):16671-16676.
58. Su H M & Tai J H (1996) Genomic organization and sequence conservation in type I *Trichomonas vaginalis* viruses. *Virology* 222(2):470-473.
59. Van Den Born E, Gultyaev A P, & Snijder E J (2004) Secondary structure and function of the 5'-proximal region of the equine arteritis virus RNA genome. *RNA* 10(3):424-437.
60. Xu J, Hendrix R W, & Duda R L (2004) Conserved translational frameshift in dsDNA bacteriophage tail assembly genes. *Mol Cell* 16(1):11-21.
61. Ziebuhr J, Snijder E J, & Gorbalenya A E (2000) Virus-encoded proteinases and proteolytic processing in the Nidovirales. *Journal of General virology* 81(4):853-879.

Published US Patent Application No. 2010/0136047 is hereby incorporated by reference in its entirety.

While specific embodiments have been described above with reference to the disclosed embodiments and examples, such embodiments are only illustrative and do not limit the scope of the invention. Changes and modifications can be made in accordance with ordinary skill in the art without departing from the invention in its broader aspects as defined in the following claims.

All publications, patents, and patent documents are incorporated by reference herein, as though individually incorporated by reference. The invention has been described with reference to various specific and preferred embodiments and techniques. However, it should be understood that many variations and modifications may be made while remaining within the spirit and scope of the invention.

DESCRIPTION OF SEQUENCES

SEQ ID NO: 1 pL1a
SEQ ID NO: 2 pLnsp2-8
SEQ ID NO: 3 pLnsp1-2
SEQ ID NO: 4 pLnsp1β-2
SEQ ID NO: 5 pLnsp1βcc-2
SEQ ID NO: 6 pLnsp2
SEQ ID NO: 7 pLnsp1-3
SEQ ID NO: 8 pLnsp1β-3
SEQ ID NO: 9 pLnsp2-3
SEQ ID NO: 10 pLnsp2-3-IFC
SEQ ID NO: 11 pLnsp1β
SEQ ID NO: 12 pL1a-IFC
SEQ ID NO: 13 pL1a-KO1
SEQ ID NO: 14 TTAGCTCTAGAG
SEQ ID NO: 15 pL1a-KO2
SEQ ID NO: 16TGGGTATTCGAAGTTTATAGTCATTTGCCAGCTTTTATACTGACACTT
SEQ ID NO: 17 pL1a-SS
SEQ ID NO: 18 pL1a-CC1
SEQ ID NO: 19 TTTATAGTCATTTGCC
SEQ ID NO: 20 pL1a-CC2
SEQ ID NO: 21 GTTTACAGAAATATGGCAGCTTTT
SEQ ID NO: 22 pSD-IFC
SEQ ID NO: 23 ATATTGGCGCGCCtaatacgactcactatagg
SEQ ID NO: 24 GGCGCGCCtaatacgactcactatagg
SEQ ID NO: 25 pSD-KO1
SEQ ID NO: 26 pSD-KO2
SEQ ID NO: 27 NC_001639—LDV (from FIG. 2A)
SEQ ID NO: 28 NC_001961 PRRSV Ref. seq (from FIG. 2A)
SEQ ID NO: 29 Genotype II PRRSV isolate SC23983 (from FIG. 2A)
SEQ ID NO: 30 DQ489311—isolate SD01-08 (from FIG. 2A)
SEQ ID NO: 31 NC_003092—SHFV (from FIG. 2A)
SEQ ID NO: 32 HQ845737-8—SHFV strain krc1 (from FIG. 2A)
SEQ ID NO: 33 HQ845737-8—SHFV strain krc2 (from FIG. 2A)
SEQ ID NO: 34 (WILD TYPE FROM FIG. 9 A)
SEQ ID NO: 35 (Mutated nucleotide in pLnsp1βcc-2 from FIG. 9A)
SEQ ID NO: 36 (Amino acids from FIG. 9A)
SEQ ID NO: 37 PRRSV-EU/DQ489311/SD01-08 From FIG. 2B
SEQ ID NO: 38 PRRSV-EU/DQ489311/SD01-08 IFC From FIG. 2B
SEQ ID NO: 39 PRRSV-EU/DQ489311/SD01-08: KO1 TF codon 100
SEQ ID NO: 40 From FIG. 2B PRRSV-EU/DQ489311/SD01-08: KO2
SEQ ID NO: 41 From FIG. 2B PRRSV-EU/DQ489311/SD01-08: SS
SEQ ID NO: 42 From FIG. 2B PRRSV-EU/DQ489311/SD01-08: CC1
SEQ ID NO: 43 From FIG. 2B PRRSV-EU/DQ489311/SD01-08: CC2

SEQ ID NO: 44 wild type 2b
SEQ ID NO: 45 From FIG. 5B Amino acid sequence of nsp2TF
SEQ ID NO: 46 From FIG. 5B partial of nsp2TF
SEQ ID NO: 47 From FIG. 5B partial of nsp2TF
SEQ ID NO: 48 From FIG. 5B partial of nsp2TF
SEQ ID NO: 49 From FIG. 5B partial of nsp2TF
SEQ ID NO: 50 From FIG. 5B partial of nsp2TF
SEQ ID NO: 51 From FIG. 5B partial of nsp2TF
SEQ ID NO: 52 From FIG. 5B partial of nsp2TF
SEQ ID NO: 53 From FIG. 5B partial of nsp2TF
SEQ ID NO: 54 From FIG. 5B partial of nsp2TF
SEQ ID NO: 55 From FIG. 5B partial of nsp2TF
SEQ ID NO: 56 From FIG. 5B partial of nsp2TF
SEQ ID NO: 57 From FIG. 5B partial of nsp2TF
SEQ ID NO: 58 From FIG. 5B partial of nsp2TF
SEQ ID NO: 59 From FIG. 5B partial of nsp2TF
SEQ ID NO: 60 From FIG. 5B partial of nsp2TF
SEQ ID NO: 61 From FIG. 5B partial of nsp2TF
SEQ ID NO: 62 From FIG. 5B partial of nsp2TF
SEQ ID NO: 63 From FIG. 5B partial of nsp2TF
SEQ ID NO: 64 From FIG. 5B partial of nsp2TF
SEQ ID NO: 65 From FIG. 5B partial of nsp2TF
SEQ ID NO: 66 From FIG. 5B partial of nsp2TF
SEQ ID NO: 67 From FIG. 5B partial of nsp2TF
SEQ ID NO: 68 From FIG. 5A
SEQ ID NO: 69 From FIG. 5A
SEQ ID NO: 70 From FIG. 5A
SEQ ID NO: 71 From FIG. 5A
SEQ ID NO: 72 From FIG. 5A
SEQ ID NO: 73 From FIG. 5A
SEQ ID NO: 74 From FIG. 5A
SEQ ID NO: 75 From FIG. 5A
SEQ ID NO: 76 From FIG. 6B
SEQ ID NO: 77 From FIG. 6B
SEQ ID NO: 78 From FIG. 6B
SEQ ID NO: 79 From FIG. 6B
SEQ ID NO: 80 From FIG. 6B
SEQ ID NO: 81 From FIG. 6B
SEQ ID NO: 82 From FIG. 6B
SEQ ID NO: 83 From FIG. 6B
SEQ ID NO: 84 From FIG. 6B
SEQ ID NO: 85 From FIG. 6B
SEQ ID NO: 86 From FIG. 6B
SEQ ID NO: 87 From FIG. 6B
SEQ ID NO: 88 From FIG. 6B
SEQ ID NO: 89 From FIG. 6B
SEQ ID NO: 90 From FIG. 6B
SEQ ID NO: 91 From FIG. 6B
SEQ ID NO: 92 PSD01-08-KO1
SEQ ID NO: 93 PSD-08-KO2
SEQ ID NO: 94 PSDp1-08-KO3
SEQ ID NO: 95 PSD95-28-KO1
SEQ ID NO: 96 PSD95-28-KO2
SEQ ID NO: 97 PSD95-28-KO3
SEQ ID NO: 98 From FIG. 2C WT
SEQ ID NO: 99 From FIG. 2C IFC
SEQ ID NO: 100 from FIG. 2C M1
SEQ ID NO: 101 From FIG. 2C CC
SEQ ID NO: 102 From FIG. 2C KO2
SEQ ID NO: 103 From FIG. 2C WT 4067
SEQ ID NO: 104 From FIG. 2C KO1 4067
SEQ ID NO: 105 From FIG. 2D HQ845737
SEQ ID NO: 106 From FIG. 2D HQ845738
SEQ ID NO: 107 From FIG. 2D NC_003092
SEQ ID NO: 108 From FIG. 2D JX473849
SEQ ID NO: 109 From FIG. 2D JX473848
SEQ ID NO: 110 From FIG. 2D JX473850
SEQ ID NO: 111 From FIG. 2D JX473847
SEQ ID NO: 112 XH-GD from FIG. 10B
SEQ ID NO: 113 JX143 from FIG. 10B
SEQ ID NO: 114 JXA1 from FIG. 10B
SEQ ID NO: 115 JA142 from FIG. 10B
SEQ ID NO: 116 Ingelvac from FIG. 10B
SEQ ID NO: 117 NVSL from FIG. 10B
SEQ ID NO: 118 CH-1a from FIG. 10B
SEQ ID NO: 119 CH-1R from FIG. 10B
SEQ ID NO: 120 P129 from FIG. 10B
SEQ ID NO: 121 RespPRRS from FIG. 10B
SEQ ID NO: 122 SD-95-21 from FIG. 10B
SEQ ID NO: 123 PA8 from FIG. 10B
SEQ ID NO: 124 VR2332 from FIG. 10B
SEQ ID NO: 125 Prime from FIG. 10B
SEQ ID NO: 126 SP from FIG. 10B
SEQ ID NO: 127 MN184 from FIG. 10B
SEQ ID NO: 128 Amervac from FIG. 10B
SEQ ID NO: 129 SHE from FIG. 10B
SEQ ID NO: 130 LV from FIG. 10B
SEQ ID NO: 131 SD01-08 from FIG. 10B
SEQ ID NO: 132 EuroPRRSV from FIG. 10B
SEQ ID NO: 133 NMEU09-1 from FIG. 10B
SEQ ID NO: 134 07V063 from FIG. 10B
SEQ ID NO: 135 BJEU06-1 from FIG. 10B
SEQ ID NO: 136 HKEU16 from FIG. 10B
SEQ ID NO: 137 KNU-07 from FIG. 10B
SEQ ID NO: 138 AA 95-21 from FIG. 12A
SEQ ID NO: 139 Aa 01-08 from FIG. 12B
SEQ ID NO: 140 RP0a_LDVC from FIG. 13
SEQ ID NO: 141 RPOA_LDVP from FIG. 13
SEQ ID NO: 142 RPOA_PRRSL from FIG. 13
SEQ ID NO: 143 RPOA_PRRSS from FIG. 13
SEQ ID NO: 144 3MTV_A from FIG. 13
SEQ ID NO: 145 RPOA_PRRSB from FIG. 13
SEQ ID NO: 146 RPOA_PRRSR from FIG. 13
SEQ ID NO: 147 RPOA_PRRS1 from FIG. 13
SEQ ID NO: 148 RPOA_SHFV from FIG. 13
SEQ ID NO: 149 Conserved motif from FIG. 13

SEQUENCE LISTING (149 sequences)

SEQ ID NO: 1 - DNA, 11144 bp, Porcine reproductive and respiratory syndrome virus
cccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgataataccatggctgggacgttctcccggtgcatgtgcaccccggctgcccgggtattttggaacgccggccaagtcttttgcacacggtgtctcagtgcgcggcctcttctctctccggaacttcaggacactgacctcggtgtagttggattgttttacaagcctaaggacaagattcactggaaagttcctatcggcattcctcaggtggagtgtactccatccgggtgctgctggctctcagccgtattccctttggcgcgcatgacttccggtaatcacaacttcctccaacgacttgttaaggttgctgatgttttgtatcgcgatggttgcttggcgcctcgacacctccgtgaactccaagtttacgagcgcggttgtagctggtacccaattacggggcccgtacccggaatgggtttgtttgcgaactccatgcacgtgtctgaccagccgttccctggtgccacccatgtgttgactaactcgcctctgcctcagcgggcgtgccggcagccgttctgtccatttgaggaagctcattctgacgtttacaggtggaagaaatttgtgatttttacggactcctctcccaacggtcgatttcgcatgatgtggacgccggaatccgatgactcagccgccctggaggtgctgccgcccgagttagaacgtcaggtcgagatcctcactcggagttttcccgctcatcaccctatcaacctagctgactgggagctcactgagtcccctgagaacggtttttctttcggcacgtcccattcttgcggccacatcgtccagaaccccaacgtgtttgacggcaagtgctggctcacctgctttttgggccaatcggctgaagtgtgctaccacgaggaacatctagctaacgccctcggttaccaaaccaagtggggcgtgcatggtaagtacctccaacgcaggcttcaagtccgcggcatgcgtgctgtggtcgatcctgacggccctattcacgttgaagcgctgtcttgctcccagtcttgggtcaggcacctgactctgaataatgatgtcaccccaggattcgttcgcctgacatccatccgcattgtgtccaacacagaacccaccgctttccggatctttcggtttggagcacataagtggtatggcgctgccggcaaacgggctcgtgccaaacgtgccaccaaaagtgggaaggattcggccctcgctcccaagattgccccaccggtccccacctgtggaatcaccacctactctccaccgacagacgggtcttgtggttggcacgttcttgccgccatagtgaatcggatgataaacggtgactttacgtcccccctgcctcagtacaacagaccagaggatgattgggcttctgattatgatcttgctcaggcgattcaatgtttacaactgcctgccaccgtggttcggaatcgcgcctgtcctaacgccaagtacctcataaagctaaacggggttcactgggaagtagaggtgagatctggaatggctcctcgttccctttctcgtgaatgtgtagttggcgtttgctctgaaggctgtgtcgcaccgccttatccagcggacgggcttcctaaacgtgcactcgaggccttggcgtctgcctacagactaccctcagattgtgttagctctggtattgctgactttcttgctgatccacctcctcaggaattctggactctcgacaaaatgttgacctccccgtcaccggagcggtccggcttctccagcttgtataaattactcttagaggttgttccgcaaaaatgtggtgctacggaaggggctttcgtctatgctgttgagaggatgttaaaggactgtccgagccccgaacaggcgatggcccttctggcaaaaattaaagttccatcctcaaaggccccgtctgtgtccttggacgagtgttttcctgcgggtgttccagccgacttcgagccagcatttcaggaaaggccccaaagtcccggtgctgctgtcgccctgtgttcaccggacgcaaaagggttcgagggaacagcctcggaagaagctcaagagagtggccataaggccgtccacgctgtaccccttgccgaaggtcccaataatgaacaggtacaggtggttgctggtgagcagctagagctcggcggttgtggtttggcaatcgggagtgctcagtcctcttcagactccaagagagaaaacatgcacaatagccgggaagacgaaccattggatttgtcccacccagcaccggctgccacgacgacccttgtgggagagcaaacacccgacaacccaggttctgatgccagtgctctccccatcgccgttcgaggatttgtcccgacagggcccatactccgtcatgttgagcactgcggcacagagtcaggcgacagcagttcgcctttggatctgtcttttgcgcaaacgttggaccagcctttagatctatccttggccgcttggccggtgaaggccaccgcgtctgatcctggctgggtccgcggtaggtgcgagcctgtctttttaaagcctcggaaagctttctctgatggcgattcggcccttcagttcggggagctttctgagtccagctctgtcatcgagtttgaccagacaaaagatactctggtggctgacgcccctgttgacttgacgacttcgaacgaggccctctctgcagtcgacccttccgaatttgtcgaactcaggcgcccgcgtcattccgcacaagccttaattgaccgaggcggtccacttgctgatgtccatgcgaaaataaagaaccgggtgtatgaacagtgcctccaagcttgtgagcctggtagtcgtgcaaccccagccaccagggagtggctcgacaaaatgtgggatagggtggacatgaaaacttggcgctgcacttcacagttccaggccggtcgcattcttgcgtccctcaaatttcttcctgacatgattcaagacacgccgcctcctgtccccaagaagaaccgagctagtgacagtgccggtctgaagcaactggtggcacggtgggataagaaattgagtgtaaccccccccccaaaatcggctgggttagtgcttgaccagaccgtccctccgcctacggatatccagcaagaggatgccaccccctccgacgggttatcccatgcatcggatttttctagtcgagtgagcacgagctggagttggaaaggccttatgctttccggcacccgtctcgcggggtctgctggtcagcgcctcatgacatgggtttttgaagtttactcccatctcccagcttttatactcacacttttctcgccgcggggctctatggctccaggcgattggttgtttgcaggtgttgttttacttgctctcttgctctgtcgttcttacccaatactcggatgccttcccttactgggtgtcttctctggttctttgcggcgtgttcgtctgggtgtttttggttcttggatggcttttgctgtatttttattctcgactccatccaacccagtcggttcttcttgtgaccacgattcgccggaatgtcatgctgagcttttggctcttgagcagcgccaactttgggaacctgtgcgcggccttgtggttggcccctcaggtctcttatgtgtcatccttggcaagttactcggtgggtcacgtcatctctggcatgttatcctacgtttatgcatgcttacagatttggccctttctcttgtttatgtggtgtcccaagggcgttgtcacaagtgttggggaaagtgtataaggacagctcctgctgaggtggctctcaatgtatttcctttctcgcgcgccactcgcaactctctcacatccttgtgtgatcggttccaaactcctaaaggagttgatcccgtgcacttggcaacgggttggcgcgggtgttggcgtggtgagagtcccatccatcaaccacaccaaaagcccatagcttatgccaatttggatgaaaagaaaatatctgctcaaacggtggttgctgtcccatacgaccccagtcaggctatcaaatgtctgaaggttctgcaggcgggaggggctatcgtggaccagcctacgcctgaagttgttcgtgtgtctgaaatccccttttcagccccatttttcccaaaagttccagtcaacccagattgcaggattgtggtggattcagatacttttgtggctgcagtccgctgcggttactcgacagcacaactggtcctaggccggggcaactttgccaagttgaatcagaccccccttagggactctgcctccaccaaaacgactggtggggcctcttatactcttgctgtggctcaagtgtctgtgtggactcttgttcatttcatcctcggtctttggttcacatcacctcaagtgtgtggccgaggaaccgctgacccttggtgttcaaatcccttttcgtatcctgcctacggccctggagttgtgtgctcctctcgactttgtgtgtctgccgatggggtcaccctgccattgttctcagctgtggcacaactctccggtagagaggtagggatttttattttagtgcttgtttccttgactgccttggcccatcgcctggctcttaaggcagacatgttagtggtcttttcagctttttgtgcttacgcctggcccatgagctcctggttaatctgcttctttcctatactcttaaagtgggttacccttcaccccctcactatgctttgggtgcactcattcttggtgttttgtatgccagcagccggcatcctctcactagggataactggccttctctgggcagttggccgctttacccaggttgccggaattattacaccttatgacatccaccagtatacctctgggccacgcggtgcagccgctgtagccacagccccagaaggcacttatatggccgccgtccggagagctgctttaactggacgaactttgatcttcaccccgtctgcggtcggatcccttcttgaaggtgctttcaggactcataaaccctgccttaacaccgtgaatgttgtgggttcttcccttggttctggaggggtttttaccattgatggcagaaagaccgtcgtcactgctgctcatgtgttgaacggcgacacagctagagttaccggcgactcttacaaccgcatgcacacttttaagaccagtggcgattatgcctggtcccatgctgatgactggcagggcgttgcccctgtggtcaaggttgcgaaggggtatcgcggtcgtgcctactggcaaacatcaaccggtgtcgaacccggcgtcattggggaagggttcgccttctgtttcaccaactgtggcgattcggggtcacccgtcatctcagaatctggtgatctcatcggaatccataccggttcaaacaaactcggttctggtcttgtgacgacccctgaaggggaaacctgcgccatcaaagaaaccaagctctctgacctttccagacattttgcgggcccgagcgtccctcttggggacattaaattgagtccggccatcgtccctgatgtaacatctattccgagtgacttggcatcgctcctagcttccgtccctgtaatggaaggcggcctctcgaccgttcaacttctgtgtgtctttttccttctctggcgcatgatgggccatgcctggacacccattgttgccgtgggcttctttttgctgaatgaaattcttccagcagttttggtccgagccgtgttttcctttgcactctttattcttgcatgggccaccccctggtccgcacaggtgttaatgattagactcctcacggcatccctcaaccgcaacaagttgtctctggcgttctacgcacttgggggtgtcgtcggtttggccgctgaaatcggggcttttgccggcaggctgcctgaattgtctcaagctctttcgacatactgtttcttacctagggtccttgcgatggccagttatgttcccatcatcatcattggtggactccatgccctcggtgtgattctgtggttgttcaaataccggtgcctccacaacatgctggttggtgatgggagtttctcaagcgctttcttcctacggtattttgcagagggtaatcttagaaaaggtgtttcacagtcttgtggcatgagtaacgagtccctgacggctgctctagcttgcaagttgtcgcaggctgaccttgactttttgtccagcttaacgaacttcaagtgctttgtatctgcttcaaacatgaaaaatgctgccggccagtatattgaagcagcgtatgccaaggccctgcgccaagagttggcctccctagttcaggttgacaaaatgaaaggaattttgtctaagcttgaggcctttgctgaaacagccactccgtcccttgacgcaggtgacgtggttgttctgcttgggcaacatcctcacggatccatcctcgatattaatgtggggactgaaaggaaaactgtgtccgtgcaagagacccggagcttaggtggttccaaattcagtgtttgcactgtcgtgtccaacacacccgtggacgccttaactggcatcccactccagacaccaacccctctttttgagaatggtccgcgtcaccgtggtgaggaagacgatcttagagtcgagaggatgaagaaacactgtgtgtccctcggcttccacaacattaatggcaaagtttactgcaaaatttgggacaagtccaccggtgataccttttataccgatgattcccggtacacccaagaccttgcattccaggacaggtcagccgactacagagacagggattatgagggtgtgcaaaccgccccccaacagggctttgatccaaagtctgaaacccctattggcactgtggtgatcggcggtatcacgtataacaggtacctgatcaaaggtaaggaggtcttggttcccaagcctgacaactgccttgaagctgccaagctgtcccttgagcaagctctcgctgggatgggccaaacttgcgaccttacagctgccgaggtggaaaagttgaggcgcatcattagccagctccaaggtttgaccactgaacaggctttaaactgttaggcggccgcctcgagggatcctctactagagtcgaggcggctgctaacaaagccccaaaggaagctgagttggctgctgccaccgctgagcaataactagcataaccccttggggcctctaaacgggtcttgaggggttttttgctgaaaggaggaactatatccggatcgagatccccaattctgtgagcgtatggcaaacgaaggaaaaatagttatagtagccgcactcgatgggacatttcaacgtaaaccgtttaataattcgaggagcttttgttccctttagtgagggttaatttcgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattccgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagatccttgaagacaaacaacgtctgtagcgaccctttgcaggcagcggaaccccccacctggcgacaggtgcctctgcggccaaaagccacgtgtataagatacacctgcaaaggcggcacaac

SEQ ID NO: 2 - DNA, 9992 bp, Porcine reproductive and respiratory syndrome virus
cccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgataataccatggctgccggcaaacgggctcgtgccaaacgtgccaccaaaagtgggaaggattcggccctcgctcccaagattgccccaccggtccccacctgtggaatcaccacctactctccaccgacagacgggtcttgtggttggcacgttcttgccgccatagtgaatcggatgataaacggtgactttacgtcccccctgcctcagtacaacagaccagaggatgattgggcttctgattatgatcttgctcaggcgattcaatgtttacaactgcctgccaccgtggttcggaatcgcgcctgtcctaacgccaagtacctcataaagctaaacggggttcactgggaagtagaggtgagatctggaatggctcctcgttccctttctcgtgaatgtgtagttggcgtttgctctgaaggctgtgtcgcaccgccttatccagcggacgggcttcctaaacgtgcactcgaggccttggcgtctgcctacagactaccctcagattgtgttagctctggtattgctgactttcttgctgatccacctcctcaggaattctggactctcgacaaaatgttgacctccccgtcaccggagcggtccggcttctccagcttgtataaattactcttagaggttgttccgcaaaaatgtggtgctacggaaggggctttcgtctatgctgttgagaggatgttaaaggactgtccgagccccgaacaggcgatggcccttctggcaaaaattaaagttccatcctcaaaggccccgtctgtgtccttggacgagtgttttcctgcgggtgttccagccgacttcgagccagcatttcaggaaaggccccaaagtcccggtgctgctgtcgccctgtgttcaccggacgcaaaagggttcgagggaacagcctcggaagaagctcaagagagtggccataaggccgtccacgctgtaccccttgccgaaggtcccaataatgaacaggtacaggtggttgctggtgagcagctagagctcggcggttgtggtttggcaatcgggagtgctcagtcctcttcagactccaagagagaaaacatgcacaatagccgggaagacgaaccattggatttgtcccacccagcaccggctgccacgacgacccttgtgggagagcaaacacccgacaacccaggttctgatgccagtgctctccccatcgccgttcgaggatttgtcccgacagggcccatactccgtcatgttgagcactgcggcacagagtcaggcgacagcagttcgcctttggatctgtcttttgcgcaaacgttggaccagcctttagatctatccttggccgcttggccggtgaaggccaccgcgtctgatcctggctgggtccgcggtaggtgcgagcctgtctttttaaagcctcggaaagctttctctgatggcgattcggcccttcagttcggggagctttctgagtccagctctgtcatcgagtttgaccagacaaaagatactctggtggctgacgcccctgttgacttgacgacttcgaacgaggccctctctgcagtcgacccttccgaatttgtcgaactcaggcgcccgcgtcattccgcacaagccttaattgaccgaggcggtccacttgctgatgtccatgcgaaaataaagaaccgggtgtatgaacagtgcctccaagcttgtgagcctggtagtcgtgcaaccccagccaccagggagtggctcgacaaaatgtgggatagggtggacatgaaaacttggcgctgcacttcacagttccaggccggtcgcattcttgcgtccctcaaatttcttcctgacatgattcaagacacgccgcctcctgtccccaagaagaaccgagctagtgacagtgccggtctgaagcaactggtggcacggtgggataagaaattgagtgtaaccccccccccaaaatcggctgggttagtgcttgaccagaccgtccctccgcctacggatatccagcaagaggatgccaccccctccgacgggttatcccatgcatcggatttttctagtcgagtgagcacgagctggagttggaaaggccttatgctttccggcacccgtctcgcggggtctgctggtcagcgcctcatgacatgggtttttgaagtttactcccatctcccagcttttatactcacacttttctcgccgcggggctctatggctccaggcgattggttgtttgcaggtgttgttttacttgctctcttgctctgtcgttcttacccaatactcggatgccttcccttactgggtgtcttctctggttctttgcggcgtgttcgtctgggtgtttttggttcttggatggcttttgctgtatttttattctcgactccatccaacccagtcggttcttcttgtgaccacgattcgccggaatgtcatgctgagcttttggctcttgagcagcgccaactttgggaacctgtgcgcggccttgtggttggcccctcaggtctcttatgtgtcatccttggcaagttactcggtgggtcacgtcatctctggcatgttatcctacgtttatgcatgcttacagatttggccctttctcttgtttatgtggtgtcccaagggcgttgtcacaagtgttggggaaagtgtataaggacagctcctgctgaggtggctctcaatgtatttcctttctcgcgcgccactcgcaactctctcacatccttgtgtgatcggttccaaactcctaaaggagttgatcccgtgcacttggcaacgggttggcgcgggtgttggcgtggtgagagtcccatccatcaaccacaccaaaagcccatagcttatgccaatttggatgaaaagaaaatatctgctcaaacggtggttgctgtcccatacgaccccagtcaggctatcaaatgtctgaaggttctgcaggcgggaggggctatcgtggaccagcctacgcctgaagttgttcgtgtgtctgaaatccccttttcagccccatttttcccaaaagttccagtcaacccagattgcaggattgtggtggattcagatacttttgtggctgcagtccgctgcggttactcgacagcacaactggtcctaggccggggcaactttgccaagttgaatcagaccccccttagggactctgcctccaccaaaacgactggtggggcctcttatactcttgctgtggctcaagtgtctgtgtggactcttgttcatttcatcctcggtctttggttcacatcacctcaagtgtgtggccgaggaaccgctgacccttggtgttcaaatcccttttcgtatcctgcctacggccctggagttgtgtgctcctctcgactttgtgtgtctgccgatggggtcaccctgccattgttctcagctgtggcacaactctccggtagagaggtagggatttttattttagtgcttgtttccttgactgccttggcccatcgcctggctcttaaggcagacatgttagtggtcttttcagctttttgtgcttacgcctggcccatgagctcctggttaatctgcttctttcctatactcttaaagtgggttacccttcaccccctcactatgctttgggtgcactcattcttggtgttttgtatgccagcagccggcatcctctcactagggataactggccttctctgggcagttggccgctttacccaggttgccggaattattacaccttatgacatccaccagtatacctctgggccacgcggtgcagccgctgtagccacagccccagaaggcacttatatggccgccgtccggagagctgctttaactggacgaactttgatcttcaccccgtctgcggtcggatcccttcttgaaggtgctttcaggactcataaaccctgccttaacaccgtgaatgttgtgggttcttcccttggttctggaggggtttttaccattgatggcagaaagaccgtcgtcactgctgctcatgtgttgaacggcgacacagctagagttaccggcgactcttacaaccgcatgcacacttttaagaccagtggcgattatgcctggtcccatgctgatgactggcagggcgttgcccctgtggtcaaggttgcgaaggggtatcgcggtcgtgcctactggcaaacatcaaccggtgtcgaacccggcgtcattggggaagggttcgccttctgtttcaccaactgtggcgattcggggtcacccgtcatctcagaatctggtgatctcatcggaatccataccggttcaaacaaactcggttctggtcttgtgacgacccctgaaggggaaacctgcgccatcaaagaaaccaagctctctgacctttccagacattttgcgggcccgagcgtccctcttggggacattaaattgagtccggccatcgtccctgatgtaacatctattccgagtgacttggcatcgctcctagcttccgtccctgtaatggaaggcggcctctcgaccgttcaacttctgtgtgtctttttccttctctggcgcatgatgggccatgcctggacacccattgttgccgtgggcttctttttgctgaatgaaattcttccagcagttttggtccgagccgtgttttcctttgcactctttattcttgcatgggccaccccctggtccgcacaggtgttaatgattagactcctcacggcatccctcaaccgcaacaagttgtctctggcgttctacgcacttgggggtgtcgtcggtttggccgctgaaatcggggcttttgccggcaggctgcctgaattgtctcaagctctttcgacatactgtttcttacctagggtccttgcgatggccagttatgttcccatcatcatcattggtggactccatgccctcggtgtgattctgtggttgttcaaataccggtgcctccacaacatgctggttggtgatgggagtttctcaagcgctttcttcctacggtattttgcagagggtaatcttagaaaaggtgtttcacagtcttgtggcatgagtaacgagtccctgacggctgctctagcttgcaagttgtcgcaggctgaccttgactttttgtccagcttaacgaacttcaagtgctttgtatctgcttcaaacatgaaaaatgctgccggccagtatattgaagcagcgtatgccaaggccctgcgccaagagttggcctccctagttcaggttgacaaaatgaaaggaattttgtctaagcttgaggcctttgctgaaacagccactccgtcccttgacgcaggtgacgtggttgttctgcttgggcaacatcctcacggatccatcctcgatattaatgtggggactgaaaggaaaactgtgtccgtgcaagagacccggagcttaggtggttccaaattcagtgtttgcactgtcgtgtccaacacacccgtggacgccttaactggcatcccactccagacaccaacccctctttttgagaatggtccgcgtcaccgtggtgaggaagacgatcttagagtcgagaggatgaagaaacactgtgtgtccctcggcttccacaacattaatggcaaagtttactgcaaaatttgggacaagtccaccggtgataccttttataccgatgattcccggtacacccaagaccttgcattccaggacaggtcagccgactacagagacagggattatgagggtgtgcaaaccgccccccaacagggctttgatccaaagtctgaaacccctattggcactgtggtgatcggcggtatcacgtataacaggtacctgatcaaaggtaaggaggtcttggttcccaagcctgacaactgccttgaagctgccaagctgtcccttgagcaagctctcgctgggatgggccaaacttgcgaccttacagctgccgaggtggaaaagttgaggcgcatcattagccagctccaaggtttgaccactgaacaggctttaaactgttaggcggccgcctcgagggatcctctactagagtcgaggcggctgctaacaaagccccaaaggaagctgagttggctgctgccaccgctgagcaataactagcataaccccttggggcctctaaacgggtcttgaggggttttttgctgaaaggaggaactatatccggatcgagatccccaattctgtgagcgtatggcaaacgaaggaaaaatagttatagtagccgcactcgatgggacatttcaacgtaaaccgtttaataattcgaggagcttttgttccctttagtgagggttaatttcgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattccgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagatccttgaagacaaacaacgtctgtagcgaccctttgcaggcagcggaaccccccacctggcgacaggtgcctctgcggccaaaagccacgtgtataagatacacctgcaaaggcggcacaac

SEQ ID NO: 3 - DNA, 8344 bp, Porcine reproductive and respiratory syndrome virus
cccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgataataccatggctgggacgttctcccggtgcatgtgcaccccggctgcccgggtattttggaacgccggccaagtcttttgcacacggtgtctcagtgcgcggcctcttctctctccggaacttcaggacactgacctcggtgtagttggattgttttacaagcctaaggacaagattcactggaaagttcctatcggcattcctcaggtggagtgtactccatccgggtgctgctggctctcagccgtattccctttggcgcgcatgacttccggtaatcacaacttcctccaacgacttgttaaggttgctgatgttttgtatcgcgatggttgcttggcgcctcgacacctccgtgaactccaagtttacgagcgcggttgtagctggtacccaattacggggcccgtacccggaatgggtttgtttgcgaactccatgcacgtgtctgaccagccgttccctggtgccacccatgtgttgactaactcgcctctgcctcagcgggcgtgccggcagccgttctgtccatttgaggaagctcattctgacgtttacaggtggaagaaatttgtgatttttacggactcctctcccaacggtcgatttcgcatgatgtggacgccggaatccgatgactcagccgccctggaggtgctgccgcccgagttagaacgtcaggtcgagatcctcactcggagttttcccgctcatcaccctatcaacctagctgactgggagctcactgagtcccctgagaacggtttttctttcggcacgtcccattcttgcggccacatcgtccagaaccccaacgtgtttgacggcaagtgctggctcacctgctttttgggccaatcggctgaagtgtgctaccacgaggaacatctagctaacgccctcggttaccaaaccaagtggggcgtgcatggtaagtacctccaacgcaggcttcaagtccgcggcatgcgtgctgtggtcgatcctgacggccctattcacgttgaagcgctgtcttgctcccagtcttgggtcaggcacctgactctgaataatgatgtcaccccaggattcgttcgcctgacatccatccgcattgtgtccaacacagaacctaccgctttccggatctttcggtttggagcacataagtggtatggcgctgccggcaaacgggctcgtgccaaacgtgccaccaaaagtgggaaggattcggccctcgctcccaagattgccccaccggtccccacctgtggaatcaccacctactctccaccgacagacgggtcttgtggttggcacgttcttgccgccatagtgaatcggatgataaacggtgactttacgtcccccctgcctcagtacaacagaccagaggatgattgggcttctgattatgatcttgctcaggcgattcaatgtttacaactgcctgccaccgtggttcggaatcgcgcctgtcctaacgccaagtacctcataaagctaaacggggttcactgggaagtagaggtgagatctggaatggctcctcgttccctttctcgtgaatgtgtagttggcgtttgctctgaaggctgtgtcgcaccgccttatccagcggacgggcttcctaaacgtgcactcgaggccttggcgtctgcctacagactaccctcagattgtgttagctctggtattgctgactttcttgctgatccacctcctcaggaattctggactctcgacaaaatgttgacctccccgtcaccggagcggtccggcttctccagcttgtataaattactcttagaggttgttccgcaaaaatgtggtgctacggaaggggctttcgtctatgctgttgagaggatgttaaaggactgtccgagccccgaacaggccatggcccttctggcaaaaattaaagttccatcctcaaaggccccgtctgtgtccttggacgagtgttttcctgcgggtgttccagccgacttcgagccagcatttcaggaaaggccccgaagtcccggtgctgctgtcgccctgtgttcaccggacgcaaaagggttcgagggaacagcctcggaagaagctcaagagagtggccataaggccgtccacgctgtaccccttgccgaaggtcccaataatgaacaggtacaggtggttgctggtgagcagctagagctcggcggttgtggtttggcaatcgggagtgctcagtcctcttcagactccaagagagaaaacatgcacaatagccgggaagacgaaccattggatttgtcccacccagcaccggctgccacgacgacccttgtgggagagcaaacacccgacaacccaggttctgatgccagtgctctccccatcgccgttcgaggatttgtcccgacagggcccatactccgtcatgttgagcactgcggcacagagtcaggcgacagcagttcgcctttggatctgtcttttgcgcaaacgttggaccagcctttagatctatccttggccgcttggccggtgaaggccaccgcgtctgatcctggctgggtccgcggtaggtgcgagcctgtctttttaaagcctcggaaagctttctctgatggcgattcggcccttcagttcggggagctttctgagtccagctctgtcatcgagtttgaccagacaaaagatactctggtggctgacgcccctgttgacttgacgacttcgaacgaggccctctctgcagtcgacccttccgaatttgtcgaactcaggcgcccgcgtcattccgcacaagccttaattgaccgaggcggtccacttgctgatgtccatgcgaaaataaagaaccgggtgtatgaacagtgcctccaagcttgtgagcctggtagtcgtgcaaccccagccaccagggagtggctcgacaaaatgtgggatagggtggacatgaaaacttggcgctgcacttcacagttccaggccggtcgcattcttgcgtccctcaaattccttcctgacatgattcaagacacgccgcctcctgtccccaggaagaaccgagctagtgacaatgccggtctgaagcaactggtggcacggtgggataagaaattgagtgtaaccccccccccaaaatcggctgggttagtgcttgaccagaccgtccctccgcctacggatatccagcaagaggatgccaccccctccgacgggttatcccatgcatcggatttttctagtcgagtgagcacgagctggagttggaaaggccttatgctttccggcacccgtctcgcggggtctgctggtcagcgcctcatgacatgggtttttgaagtttactcccatctcccagcttttatactcacacttttctcgccgcggggctctatggctccaggcgattggttgtttgcaggtgttgttttacttgctctcttgctctgtcgttcttacccaatactcggatgccttcccttactgggtgtcttttctggttctttgcggcgtgttcgtctgggtgtttttggttcttggatggcttttgctgtatttttattctcgactccatccaacccagtcggttcttcttgtgaccacgattcgccggaatgtcatgctgagcttttggctcttgagcagcgccaactttgggaacctgtgcgcggccttgtggttggcccctcaggtctcttatgtgtcatccttggcaagttactcggtgggtcacgtcatctctggcatgttatcctacgtttatgcatgcttacagatttggccctttctcttgtttatgtggtgtcccaagggcgttgtcacaagtgttggggaaagtgtataaggacagctcctgctgaggtggctctcaatgtatttcctttctcgcgcgccactcgcaactctctcacatccttgtgtgatcggttccaaactcctaaaggagttgatcccgtgcacttggcaacgggttggcgcgggtgttggcgtggtgagagtcccatccatcaaccacaccaaaagcccatagcttatgccaatttggatgaaaagaaaatatctgctcaaacggtggttgctgtcccatacgaccccagtcaggctatcaaatgtctgaaggttctgcaggcgggaggggctatcgtggaccagcctacgcctgaagttgttcgtgtgtctgaaatcccttttcagccccatttttcccaaaagttccagtcaacccagattgcaggattgtggtggattcagatacttttgtggctgcagtccgctgcggttactcgacagcacaactggtcctaggccggggcaactttgccaagttgaatcagaccccccttagggactctgcctccaccaaaacgactggtgggtaggcggccgcctcgagggatcctctactagagtcgaggcggctgctaacaaagccccaaaggaagctgagttggctgctgccaccgctgagcaataactagcataaccccttggggcctctaaacgggtcttgaggggttttttgctgaaaggaggaactatatccggatcgagatccccaattctgtgagcgtatggcaaacgaaggaaaaatagttatagtagccgcactcgatgggacatttcaacgtaaaccgtttaataattcgaggagcttttgttccctttagtgagggttaatttcgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattccgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagatccttgaagacaaacaacgtctgtagcgaccctttgcaggcagcggaaccccccacctggcgacaggtgcctctgcggccaaaagccacgtgtataagatacacctgcaaaggcggcacaac

SEQ ID NO: 4 - DNA, 7808 bp, Porcine reproductive and respiratory syndrome virus
cccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgataataccatggctgacgtttacaggtggaagaaatttgtgatttttacggactcctctcccaacggtcgatttcgcatgatgtggacgccggaatccgatgactcagccgccctggaggtgctgccgcccgagttagaacgtcaggtcgagatcctcactcggagttttcccgctcatcaccctatcaacctagctgactgggagctcactgagtcccctgagaacggtttttctttcggcacgtcccattcttgcggccacatcgtccagaaccccaacgtgtttgacggcaagtgctggctcacctgctttttgggccaatcggctgaagtgtgctaccacgaggaacatctagctaacgccctcggttaccaaaccaagtggggcgtgcatggtaagtacctccaacgcaggcttcaagtccgcggcatgcgtgctgtggtcgatcctgacggccctattcacgttgaagcgctgtcttgctcccagtcttgggtcaggcacctgactctgaataatgatgtcaccccaggattcgttcgcctgacatccatccgcattgtgtccaacacagaacccaccgctttccggatctttcggtttggagcacataagtggtatggcgctgccggcaaacgggctcgtgccaaacgtgccaccaaaagtgggaaggattcggccctcgctcccaagattgccccaccggtccccacctgtggaatcaccacctactctccaccgacagacgggtcttgtggttggcacgttcttgccgccatagtgaatcggatgataaacggtgactttacgtcccccctgcctcagtacaacagaccagaggatgattgggcttctgattatgatcttgctcaggcgattcaatgtttacaactgcctgccaccgtggttcggaatcgcgcctgtcctaacgccaagtacctcataaagctaaacggggttcactgggaagtagaggtgagatctggaatggctcctcgttccctttctcgtgaatgtgtagttggcgtttgctctgaaggctgtgtcgcaccgccttatccagcggacgggcttcctaaacgtgcactcgaggccttggcgtctgcctacagactaccctcagattgtgttagctctggtattgctgactttcttgctgatccacctcctcaggaattctggactctcgacaaaatgttgacctccccgtcaccggagcggtccggcttctccagcttgtataaattactcttagaggttgttccgcaaaaatgtggtgctacggaaggggctttcgtctatgctgttgagaggatgttaaaggactgtccgagccccgaacaggcgatggcccttctggcaaaaattaaagttccatcctcaaaggccccgtctgtgtccttggacgagtgttttcctgcgggtgttccagccgacttcgagccagcatttcaggaaaggccccaaagtcccggtgctgctgtcgccctgtgttcaccggacgcaaaagggttcgagggaacagcctcggaagaagctcaagagagtggccataaggccgtccacgctgtaccccttgccgaaggtcccaataatgaacaggtacaggtggttgctggtgagcagctagagctcggcggttgtggtttggcaatcgggagtgctcagtcctcttcagactccaagagagaaaacatgcacaatagccgggaagacgaaccattggatttgtcccacccagcaccggctgccacgacgacccttgtgggagagcaaacacccgacaacccaggttctgatgccagtgctctccccatcgccgttcgaggatttgtcccgacagggcccatactccgtcatgttgagcactgcggcacagagtcaggcgacagcagttcgcctttggatctgtcttttgcgcaaacgttggaccagcctttagatctatccttggccgcttggccggtgaaggccaccgcgtctgatcctggctgggtccgcggtaggtgcgagcctgtctttttaaagcctcggaaagctttctctgatggcgattcggcccttcagttcggggagctttctgagtccagctctgtcatcgagtttgaccagacaaaagatactctggtggctgacgcccctgttgacttgacgacttcgaacgaggccctctctgcagtcgacccttccgaatttgtcgaactcaggcgcccgcgtcattccgcacaagccttaattgaccgaggcggtccacttgctgatgtccatgcgaaaataaagaaccgggtgtatgaacagtgcctccaagcttgtgagcctggtagtcgtgcaaccccagccaccagggagtggctcgacaaaatgtgggatagggtggacatgaaaacttggcgctgcacttcacagttccaggccggtcgcattcttgcgtccctcaaatttcttcctgacatgattcaagacacgccgcctcctgtccccaagaagaaccgagctagtgacagtgccggtctgaagcaactggtggcacggtgggataagaaattgagtgtaaccccccccccaaaatcggctgggttagtgcttgaccagaccgtccctccgcctacggatatccagcaagaggatgccaccccctccgacgggttatcccatgcatcggatttttctagtcgagtgagcacgagctggagttggaaaggccttatgctttccggcacccgtctcgcggggtctgctggtcagcgcctcatgacatgggtttttgaagtttactcccatctcccagcttttatactcacacttttctcgccgcggggctctatggctccaggcgattggttgtttgcaggtgttgttttacttgctctcttgctctgtcgttcttacccaatactcggatgccttcccttactgggtgtcttctctggttctttgcggcgtgttcgtctgggtgtttttggttcttggatggcttttgctgtatttttattctcgactccatccaacccagtcggttcttcttgtgaccacgattcgccggaatgtcatgctgagcttttggctcttgagcagcgccaactttgggaacctgtgcgcggccttgtggttggcccctcaggtctcttatgtgtcatccttggcaagttactcggtgggtcacgtcatctctggcatgttatcctacgtttatgcatgcttacagatttggccctttctcttgtttatgtggtgtcccaagggcgttgtcacaagtgttggggaaagtgtataaggacagctcctgctgaggtggctctcaatgtatttcctttctcgcgcgccactcgcaactctctcacatccttgtgtgatcggttccaaactcctaaaggagttgatcccgtgcacttggcaacgggttggcgcgggtgttggcgtggtgagagtcccatccatcaaccacaccaaaagcccatagcttatgccaatttggatgaaaagaaaatatctgctcaaacggtggttgctgtcccatacgaccccagtcaggctatcaaatgtctgaaggttctgcaggcgggaggggctatcgtggaccagcctacgcctgaagttgttcgtgtgtctgaaatccccttttcagccccatttttcccaaaagttccagtcaacccagattgcaggattgtggtggattcagatacttttgtggctgcagtccgctgcggttactcgacagcacaactggtcctaggccggggcaactttgccaagttgaatcagaccccccttagggactctgcctccaccaaaacgactggtgggtaggcggccgcctcgagggatcctctactagagtcgaggcggctgctaacaaagccccaaaggaagctgagttggctgctgccaccgctgagcaataactagcataaccccttggggcctctaaacgggtcttgaggggttttttgctgaaaggaggaactatatccggatcgagatccccaattctgtgagcgtatggcaaacgaaggaaaaatagttatagtagccgcactcgatgggacatttcaacgtaaaccgtttaataattcgaggagcttttgttccctttagtgagggttaatttcgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattccgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagatccttgaagacaaacaacgtctgtagcgaccctttgcaggcagcggaaccccccacctggcgacaggtgcctctgcggccaaaagccacgtgtataagatacacctgcaaaggcggcacaac

SEQ ID NO: 5 - DNA, 7805 bp, Porcine reproductive and respiratory syndrome virus
cccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgataataccatggatgtgtatagatggaaaaagttcgtcatcttcaccgatagcagccctaatggcagattcagaatgatgtggacccccgagagcgacgatagcgcugcuctcgaagtcctcccccctgaactggagagacaagtggaaattctgaccagaagcttccctgcccaccatcccattaatctggccgattgggaactgaccgaaagccccgaaaatggcttcagctttgggaccagccacagctgtgggcatattgtgcaaaatcctaatgtcttcgatgggaaatgttggctgacatgtttcctggggcagagcgccgaggtctgttatcatgaagagcacctggccaatgcuctgggctatcagacaaaatggggggtccacggcaaatatctgcagagaagactgcaggtgagagggatgagagccgtcgtggaccccgatgggcccatccatgtggaggccctcagctgtagccaaagctgggtgagacatctcaccctcaacaacgacgtgacacccggctttgtgagactcaccagcattagaatcgtcagcaataccgagcctacagcctttagaattttcagattcggcgcccacaaatggtacggggctgccggcaaacgggctcgtgccaaacgtgccaccaaaagtgggaaggattcggccctcgctcccaagattgccccaccggtccccacctgtggaatcaccacctactctccaccgacagacgggtcttgtggttggcacgttcttgccgccatagtgaatcggatgataaacggtgactttacgtcccccctgcctcagtacaacagaccagaggatgattgggcttctgattatgatcttgctcaggcgattcaatgtttacaactgcctgccaccgtggttcggaatcgcgcctgtcctaacgccaagtacctcataaagctaaacggggttcactgggaagtagaggtgagatctggaatggctcctcgttccctttctcgtgaatgtgtagttggcgtttgctctgaaggctgtgtcgcaccgccttatccagcggacgggcttcctaaacgtgcactcgaggccttggcgtctgcctacagactaccctcagattgtgttagctctggtattgctgactttcttgctgatccacctcctcaggaattctggactctcgacaaaatgttgacctccccgtcaccggagcggtccggcttctccagcttgtataaattactcttagaggttgttccgcaaaaatgtggtgctacggaaggggctttcgtctatgctgttgagaggatgttaaaggactgtccgagccccgaacaggcgatggcccttctggcaaaaattaaagttccatcctcaaaggccccgtctgtgtccttggacgagtgttttcctgcgggtgttccagccgacttcgagccagcatttcaggaaaggccccaaagtcccggtgctgctgtcgccctgtgttcaccggacgcaaaagggttcgagggaacagcctcggaagaagctcaagagagtggccataaggccgtccacgctgtaccccttgccgaaggtcccaataatgaacaggtacaggtggttgctggtgagcagctagagctcggcggttgtggtttggcaatcgggagtgctcagtcctcttcagactccaagagagaaaacatgcacaatagccgggaagacgaaccattggatttgtcccacccagcaccggctgccacgacgacccttgtgggagagcaaacacccgacaacccaggttctgatgccagtgctctccccatcgccgttcgaggatttgtcccgacagggcccatactccgtcatgttgagcactgcggcacagagtcaggcgacagcagttcgcctttggatctgtcttttgcgcaaacgttggaccagcctttagatctatccttggccgcttggccggtgaaggccaccgcgtctgatcctggctgggtccgcggtaggtgcgagcctgtctttttaaagcctcggaaagctttctctgatggcgattcggcccttcagttcggggagctttctgagtccagctctgtcatcgagtttgaccagacaaaagatactctggtggctgacgcccctgttgacttgacgacttcgaacgaggccctctctgcagtcgacccttccgaatttgtcgaactcaggcgcccgcgtcattccgcacaagccttaattgaccgaggcggtccacttgctgatgtccatgcgaaaataaagaaccgggtgtatgaacagtgcctccaagcttgtgagcctggtagtcgtgcaaccccagccaccagggagtggctcgacaaaatgtgggatagggtggacatgaaaacttggcgctgcacttcacagttccaggccggtcgcattcttgcgtccctcaaatttcttcctgacatgattcaagacacgccgcctcctgtccccaagaagaaccgagctagtgacagtgccggtctgaagcaactggtggcacggtgggataagaaattgagtgtaaccccccccccaaaatcggctgggttagtgcttgaccagaccgtccctccgcctacggatatccagcaagaggatgccaccccctccgacgggttatcccatgcatcggatttttctagtcgagtgagcacgagctggagttggaaaggccttatgctttccggcacccgtctcgcggggtctgctggtcagcgcctcatgacatgggtttttgaagtttactcccatctcccagcttttatactcacacttttctcgccgcggggctctatggctccaggcgattggttgtttgcaggtgttgttttacttgctctcttgctctgtcgttcttacccaatactcggatgccttcccttactgggtgtcttctctggttctttgcggcgtgttcgtctgggtgtttttggttcttggatggcttttgctgtatttttattctcgactccatccaacccagtcggttcttcttgtgaccacgattcgccggaatgtcatgctgagcttttggctcttgagcagcgccaactttgggaacctgtgcgcggccttgtggttggcccctcaggtctcttatgtgtcatccttggcaagttactcggtgggtcacgtcatctctggcatgttatcctacgtttatgcatgcttacagatttggccctttctcttgtttatgtggtgtcccaagggcgttgtcacaagtgttggggaaagtgtataaggacagctcctgctgaggtggctctcaatgtatttcctttctcgcgcgccactcgcaactctctcacatccttgtgtgatcggttccaaactcctaaaggagttgatcccgtgcacttggcaacgggttggcgcgggtgttggcgtggtgagagtcccatccatcaaccacaccaaaagcccatagcttatgccaatttggatgaaaagaaaatatctgctcaaacggtggttgctgtcccatacgaccccagtcaggctatcaaatgtctgaaggttctgcaggcgggaggggctatcgtggaccagcctacgcctgaagttgttcgtgtgtctgaaatccccttttcagccccatttttcccaaaagttccagtcaacccagattgcaggattgtggtggattcagatacttttgtggctgcagtccgctgcggttactcgacagcacaactggtcctaggccggggcaactttgccaagttgaatcagaccccccttagggactctgcctccaccaaaacgactggtgggtaggcggccgcctcgagggatcctctactagagtcgaggcggctgctaacaaagccccaaaggaagctgagttggctgctgccaccgctgagcaataactagcataaccccttggggcctctaaacgggtcttgaggggttttttgctgaaaggaggaactatatccggatcgagatccccaattctgtgagcgtatggcaaacgaaggaaaaatagttatagtagccgcactcgatgggacatttcaacgtaaaccgtttaataattcgaggagcttttgttccctttagtgagggttaatttcgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattccgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagatccttgaagacaaacaacgtctgtagcgaccctttgcaggcagcggaaccccccacctggcgacaggtgcctctgcggccaaaagccacgtgtataagatacacctgcaaaggcggcacaac

SEQ ID NO: 6 - DNA, 7193 bp, Porcine reproductive and respiratory syndrome virus
cccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgataataccatggctgccggcaaacgggctcgtgccaaacgtgccaccaaaagtgggaaggattcggccctcgctcccaagattgccccaccggtccccacctgtggaatcaccacctactctccaccgacagacgggtcttgtggttggcacgttcttgccgccatagtgaatcggatgataaacggtgactttacgtcccccctgcctcagtacaacagaccagaggatgattgggcttctgattatgatcttgctcaggcgattcaatgtttacaactgcctgccaccgtggttcggaatcgcgcctgtcctaacgccaagtacctcataaagctaaacggggttcactgggaagtagaggtgagatctggaatggctcctcgttccctttctcgtgaatgtgtagttggcgtttgctctgaaggctgtgtcgcaccgccttatccagcggacgggcttcctaaacgtgcactcgaggccttggcgtctgcctacagactaccctcagattgtgttagctctggtattgctgactttcttgctgatccacctcctcaggaattctggactctcgacaaaatgttgacctccccgtcaccggagcggtccggcttctccagcttgtataaattactcttagaggttgttccgcaaaaatgtggtgctacggaaggggctttcgtctatgctgttgagaggatgttaaaggactgtccgagccccgaacaggcgatggcccttctggcaaaaattaaagttccatcctcaaaggccccgtctgtgtccttggacgagtgttttcctgcgggtgttccagccgacttcgagccagcatttcaggaaaggccccaaagtcccggtgctgctgtcgccctgtgttcaccggacgcaaaagggttcgagggaacagcctcggaagaagctcaagagagtggccataaggccgtccacgctgtaccccttgccgaaggtcccaataatgaacaggtacaggtggttgctggtgagcagctagagctcggcggttgtggtttggcaatcgggagtgctcagtcctcttcagactccaagagagaaaacatgcacaatagccgggaagacgaaccattggatttgtcccacccagcaccggctgccacgacgacccttgtgggagagcaaacacccgacaacccaggttctgatgccagtgctctccccatcgccgttcgaggatttgtcccgacagggcccatactccgtcatgttgagcactgcggcacagagtcaggcgacagcagttcgcctttggatctgtcttttgcgcaaacgttggaccagcctttagatctatccttggccgcttggccggtgaaggccaccgcgtctgatcctggctgggtccgcggtaggtgcgagcctgtctttttaaagcctcggaaagctttctctgatggcgattcggcccttcagttcggggagctttctgagtccagctctgtcatcgagtttgaccagacaaaagatactctggtggctgacgcccctgttgacttgacgacttcgaacgaggccctctctgcagtcgacccttccgaatttgtcgaactcaggcgcccgcgtcattccgcacaagccttaattgaccgaggcggtccacttgctgatgtccatgcgaaaataaagaaccgggtgtatgaacagtgcctccaagcttgtgagcctggtagtcgtgcaaccccagccaccagggagtggctcgacaaaatgtgggatagggtggacatgaaaacttggcgctgcacttcacagttccaggccggtcgcattcttgcgtccctcaaatttcttcctgacatgattcaagacacgccgcctcctgtccccaagaagaaccgagctagtgacagtgccggtctgaagcaactggtggcacggtgggataagaaattgagtgtaaccccccccccaaaatcggctgggttagtgcttgaccagaccgtccctccgcctacggatatccagcaagaggatgccaccccctccgacgggttatcccatgcatcggatttttctagtcgagtgagcacgagctggagttggaaaggccttatgctttccggcacccgtctcgcggggtctgctggtcagcgcctcatgacatgggtttttgaagtttactcccatctcccagcttttatactcacacttttctcgccgcggggctctatggctccaggcgattggttgtttgcaggtgttgttttacttgctctcttgctctgtcgttcttacccaatactcggatgccttcccttactgggtgtcttctctggttctttgcggcgtgttcgtctgggtgtttttggttcttggatggcttttgctgtatttttattctcgactccatccaacccagtcggttcttcttgtgaccacgattcgccggaatgtcatgctgagcttttggctcttgagcagcgccaactttgggaacctgtgcgcggccttgtggttggcccctcaggtctcttatgtgtcatccttggcaagttactcggtgggtcacgtcatctctggcatgttatcctacgtttatgcatgcttacagatttggccctttctcttgtttatgtggtgtcccaagggcgttgtcacaagtgttggggaaagtgtataaggacagctcctgctgaggtggctctcaatgtatttcctttctcgcgcgccactcgcaactctctcacatccttgtgtgatcggttccaaactcctaaaggagttgatcccgtgcacttggcaacgggttggcgcgggtgttggcgtggtgagagtcccatccatcaaccacaccaaaagcccatagcttatgccaatttggatgaaaagaaaatatctgctcaaacggtggttgctgtcccatacgaccccagtcaggctatcaaatgtctgaaggttctgcaggcgggaggggctatcgtggaccagcctacgcctgaagttgttcgtgtgtctgaaatccccttttcagccccatttttcccaaaagttccagtcaacccagattgcaggattgtggtggattcagatacttttgtggctgcagtccgctgcggttactcgacagcacaactggtcctaggccggggcaactttgccaagttgaatcagaccccccttagggactctgcctccaccaaaacgactggtgggtaggcggccgcctcgagggatcctctactagagtcgaggcggctgctaacaaagccccaaaggaagctgagttggctgctgccaccgctgagcaataactagcataaccccttggggcctctaaacgggtcttgaggggttttttgctgaaaggaggaactatatccggatcgagatccccaattctgtgagcgtatggcaaacgaaggaaaaatagttatagtagccgcactcgatgggacatttcaacgtaaaccgtttaataattcgaggagcttttgttccctttagtgagggttaatttcgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattccgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagatccttgaagacaaacaacgtctgtagcgaccctttgcaggcagcggaaccccccacctggcgacaggtgcctctgcggccaaaagccacgtgtataagatacacctgcaaaggcggcacaac

SEQ ID NO: 7 - DNA, 9035 bp, Porcine reproductive and respiratory syndrome virus
cccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgataataccatggctgggacgttctcccggtgcatgtgcaccccggctgcccgggtattttggaacgccggccaagtcttttgcacacggtgtctcagtgcgcggcctcttctctctccggaacttcaggacactgacctcggtgtagttggattgttttacaagcctaaggacaagattcactggaaagttcctatcggcattcctcaggtggagtgtactccatccgggtgctgctggctctcagccgtattccctttggcgcgcatgacttccggtaatcacaacttcctccaacgacttgttaaggttgctgatgttttgtatcgcgatggttgcttggcgcctcgacacctccgtgaactccaagtttacgagcgcggttgtagctggtacccaattacggggcccgtacccggaatgggtttgtttgcgaactccatgcacgtgtctgaccagccgttccctggtgccacccatgtgttgactaactcgcctctgcctcagcgggcgtgccggcagccgttctgtccatttgaggaagctcattctgacgtttacaggtggaagaaatttgtgatttttacggactcctctcccaacggtcgatttcgcatgatgtggacgccggaatccgatgactcagccgccctggaggtgctgccgcccgagttagaacgtcaggtcgagatcctcactcggagttttcccgctcatcaccctatcaacctagctgactgggagctcactgagtcccctgagaacggtttttctttcggcacgtcccattcttgcggccacatcgtccagaaccccaacgtgtttgacggcaagtgctggctcacctgctttttgggccaatcggctgaagtgtgctaccacgaggaacatctagctaacgccctcggttaccaaaccaagtggggcgtgcatggtaagtacctccaacgcaggcttcaagtccgcggcatgcgtgctgtggtcgatcctgacggccctattcacgttgaagcgctgtcttgctcccagtcttgggtcaggcacctgactctgaataatgatgtcaccccaggattcgttcgcctgacatccatccgcattgtgtccaacacagaacctaccgctttccggatctttcggtttggagcacataagtggtatggcgctgccggcaaacgggctcgtgccaaacgtgccaccaaaagtgggaaggattcggccctcgctcccaagattgccccaccggtccccacctgtggaatcaccacctactctccaccgacagacgggtcttgtggttggcacgttcttgccgccatagtgaatcggatgataaacggtgactttacgtcccccctgcctcagtacaacagaccagaggatgattgggcttctgattatgatcttgctcaggcgattcaatgtttacaactgcctgccaccgtggttcggaatcgcgcctgtcctaacgccaagtacctcataaagctaaacggggttcactgggaagtagaggtgagatctggaatggctcctcgttccctttctcgtgaatgtgtagttggcgtttgctctgaaggctgtgtcgcaccgccttatccagcggacgggcttcctaaacgtgcactcgaggccttggcgtctgcctacagactaccctcagattgtgttagctctggtattgctgactttcttgctgatccacctcctcaggaattctggactctcgacaaaatgttgacctccccgtcaccggagcggtccggcttctccagcttgtataaattactcttagaggttgttccgcaaaaatgtggtgctacggaaggggctttcgtctatgctgttgagaggatgttaaaggactgtccgagccccgaacaggccatggcccttctggcaaaaattaaagttccatcctcaaaggccccgtctgtgtccttggacgagtgttttcctgcgggtgttccagccgacttcgagccagcatttcaggaaaggccccgaagtcccggtgctgctgtcgccctgtgttcaccggacgcaaaagggttcgagggaacagcctcggaagaagctcaagagagtggccataaggccgtccacgctgtaccccttgccgaaggtcccaataatgaacaggtacaggtggttgctggtgagcagctagagctcggcggttgtggtttggcaatcgggagtgctcagtcctcttcagactccaagagagaaaacatgcacaatagccgggaagacgaaccattggatttgtcccacccagcaccggctgccacgacgacccttgtgggagagcaaacacccgacaacccaggttctgatgccagtgctctccccatcgccgttcgaggatttgtcccgacagggcccatactccgtcatgttgagcactgcggcacagagtcaggcgacagcagttcgcctttggatctgtcttttgcgcaaacgttggaccagcctttagatctatccttggccgcttggccggtgaaggccaccgcgtctgatcctggctgggtccgcggtaggtgcgagcctgtctttttaaagcctcggaaagctttctctgatggcgattcggcccttcagttcggggagctttctgagtccagctctgtcatcgagtttgaccagacaaaagatactctggtggctgacgcccctgttgacttgacgacttcgaacgaggccctctctgcagtcgacccttccgaatttgtcgaactcaggcgcccgcgtcattccgcacaagccttaattgaccgaggcggtccacttgctgatgtccatgcgaaaataaagaaccgggtgtatgaacagtgcctccaagcttgtgagcctggtagtcgtgcaaccccagccaccagggagtggctcgacaaaatgtgggatagggtggacatgaaaacttggcgctgcacttcacagttccaggccggtcgcattcttgcgtccctcaaattccttcctgacatgattcaagacacgccgcctcctgtccccaggaagaaccgagctagtgacaatgccggtctgaagcaactggtggcacggtgggataagaaattgagtgtaaccccccccccaaaatcggctgggttagtgcttgaccagaccgtccctccgcctacggatatccagcaagaggatgccaccccctccgacgggttatcccatgcatcggatttttctagtcgagtgagcacgagctggagttggaaaggccttatgctttccggcacccgtctcgcggggtctgctggtcagcgcctcatgacatgggtttttgaagtttactcccatctcccagcttttatactcacacttttctcgccgcggggctctatggctccaggcgattggttgtttgcaggtgttgttttacttgctctcttgctctgtcgttcttacccaatactcggatgccttcccttactgggtgtcttttctggttctttgcggcgtgttcgtctgggtgtttttggttcttggatggcttttgctgtatttttattctcgactccatccaacccagtcggttcttcttgtgaccacgattcgccggaatgtcatgctgagcttttggctcttgagcagcgccaactttgggaacctgtgcgcggccttgtggttggcccctcaggtctcttatgtgtcatccttggcaagttactcggtgggtcacgtcatctctggcatgttatcctacgtttatgcatgcttacagatttggccctttctcttgtttatgtggtgtcccaagggcgttgtcacaagtgttggggaaagtgtataaggacagctcctgctgaggtggctctcaatgtatttcctttctcgcgcgccactcgcaactctctcacatccttgtgtgatcggttccaaactcctaaaggagttgatcccgtgcacttggcaacgggttggcgcgggtgttggcgtggtgagagtcccatccatcaaccacaccaaaagcccatagcttatgccaatttggatgaaaagaaaatatctgctcaaacggtggttgctgtcccatacgaccccagtcaggctatcaaatgtctgaaggttctgcaggcgggaggggctatcgtggaccagcctacgcctgaagttgttcgtgtgtctgaaatccccttttcagccccatttttcccaaaagttccagtcaacccagattgcaggattgtggtggattcagatacttttgtggctgcagtccgctgcggttactcgacagcacaactggtcctaggccggggcaactttgccaagttgaatcagaccccccttagggactctgcctccaccaaaacgactggtggggcctcttatactcttgctgtggctcaagtgtctgtgtggactcttgttcatttcatcctcggtctttggttcacatcacctcaagtgtgtggccgaggaaccgctgacccatggtgttcaaatcccttttcgtatcctgcctacggccctggagttgtgtgctcctctcgactttgtgtgtctgccgatggggtcaccctgccattgttctcagctgtggcacaactctccggtagagaggtagggatttttattttagtgcttgtttccttgactgccttggcccatcgcctggctcttaaggcagacatgttagtggtcttttcagctttttgtgcttacgcctggcccatgagctcctggttaatctgcttctttcctatactcttaaagtgggttacccttcaccccctcactatgctttgggtgcactcattcttggtgttttgtatgccagcagccggcatcctctcactagggataactggccttctctgggcagttggccgctttacccaggttgccggaattattacaccttatgacatccaccagtatacctctgggccacgtggtgcagccgctgtagccacagccccagaaggcacttatatggccgccgtccggagagctgctttaactggacgaactttgatcttcaccccgtctgcggtcggatcccttcttgaataggcggccgcctcgagggatcctctactagagtcgaggcggctgctaacaaagccccaaaggaagctgagttggctgctgccaccgctgagcaataactagcataaccccttggggcctctaaacgggtcttgaggggttttttgctgaaaggaggaactatatccggatcgagatccccaattctgtgagcgtatggcaaacgaaggaaaaatagttatagtagccgcactcgatgggacatttcaacgtaaaccgtttaataattcgaggagcttttgttccctttagtgagggttaatttcgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattccgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagatccttgaagacaaacaacgtctgtagcgaccctttgcaggcagcggaaccccccacctggcgacaggtgcctctgcggccaaaagccacgtgtataagatacacctgcaaaggcggcacaac

SEQ ID NO: 8 - DNA, 8498 bp, Porcine reproductive and respiratory syndrome virus
cccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgataataccatggctgacgtttacaggtggaagaaatttgtgatttttacggactcctctcccaacggtcgatttcgcatgatgtggacgccggaatccgatgactcagccgccctggaggtgctgccgcccgagttagaacgtcaggtcgagatcctcactcggagttttcccgctcatcaccctatcaacctagctgactgggagctcactgagtcccctgagaacggtttttctttcggcacgtcccattcttgcggccacatcgtccagaaccccaacgtgtttgacggcaagtgctggctcacctgctttttgggccaatcggctgaagtgtgctaccacgaggaacatctagctaacgccctcggttaccaaaccaagtggggcgtgcatggtaagtacctccaacgcaggcttcaagtccgcggcatgcgtgctgtggtcgatcctgacggccctattcacgttgaagcgctgtcttgctcccagtcttgggtcaggcacctgactctgaataatgatgtcaccccaggattcgttcgcctgacatccatccgcattgtgtccaacacagaacctaccgctttccggatctttcggtttggagcacataagtggtatggcgctgccggcaaacgggctcgtgccaaacgtgccaccaaaagtgggaaggattcggccctcgctcccaagattgccccaccggtccccacctgtggaatcaccacctactctccaccgacagacgggtcttgtggttggcacgttcttgccgccatagtgaatcggatgataaacggtgactttacgtcccccctgcctcagtacaacagaccagaggatgattgggcttctgattatgatcttgctcaggcgattcaatgtttacaactgcctgccaccgtggttcggaatcgcgcctgtcctaacgccaagtacctcataaagctaaacggggttcactgggaagtagaggtgagatctggaatggctcctcgttccctttctcgtgaatgtgtagttggcgtttgctctgaaggctgtgtcgcaccgccttatccagcggacgggcttcctaaacgtgcactcgaggccttggcgtctgcctacagactaccctcagattgtgttagctctggtattgctgactttcttgctgatccacctcctcaggaattctggactctcgacaaaatgttgacctccccgtcaccggagcggtccggcttctccagcttgtataaattactcttagaggttgttccgcaaaaatgtggtgctacggaaggggctttcgtctatgctgttgagaggatgttaaaggactgtccgagccccgaacaggccatggcccttctggcaaaaattaaagttccatcctcaaaggccccgtctgtgtccttggacgagtgttttcctgcgggtgttccagccgacttcgagccagcatttcaggaaaggccccgaagtcccggtgctgctgtcgccctgtgttcaccggacgcaaaagggttcgagggaacagcctcggaagaagctcaagagagtggccataaggccgtccacgctgtaccccttgccgaaggtcccaataatgaacaggtacaggtggttgctggtgagcagctagagctcggcggttgtggtttggcaatcgggagtgctcagtcctcttcagactccaagagagaaaacatgcacaatagccgggaagacgaaccattggatttgtcccacccagcaccggctgccacgacgacccttgtgggagagcaaacacccgacaacccaggttctgatgccagtgctctccccatcgccgttcgaggatttgtcccgacagggcccatactccgtcatgttgagcactgcggcacagagtcaggcgacagcagttcgcctttggatctgtcttttgcgcaaacgttggaccagcctttagatctatccttggccgcttggccggtgaaggccaccgcgtctgatcctggctgggtccgcggtaggtgcgagcctgtctttttaaagcctcggaaagctttctctgatggcgattcggcccttcagttcggggagctttctgagtccagctctgtcatcgagtttgaccagacaaaagatactctggtggctgacgcccctgttgacttgacgacttcgaacgaggccctctctgcagtcgacccttccgaatttgtcgaactcaggcgcccgcgtcattccgcacaagccttaattgaccgaggcggtccacttgctgatgtccatgcgaaaataaagaaccgggtgtatgaacagtgcctccaagcttgtgagcctggtagtcgtgcaaccccagccaccagggagtggctcgacaaaatgtgggatagggtggacatgaaaacttggcgctgcacttcacagttccaggccggtcgcattcttgcgtccctcaaattccttcctgacatgattcaagacacgccgcctcctgtccccaggaagaaccgagctagtgacaatgccggtctgaagcaactggtggcacggtgggataagaaattgagtgtaaccccccccccaaaatcggctgggttagtgcttgaccagaccgtccctccgcctacggatatccagcaagaggatgccaccccctccgacgggttatcccatgcatcggatttttctagtcgagtgagcacgagctggagttggaaaggccttatgctttccggcacccgtctcgcggggtctgctggtcagcgcctcatgacatgggtttttgaagtttactcccatctcccagcttttatactcacacttttctcgccgcggggctctatggctccaggcgattggttgtttgcaggtgttgttttacttgctctcttgctctgtcgttcttacccaatactcggatgccttcccttactgggtgtcttttctggttctttgcggcgtgttcgtctgggtgtttttggttcttggatggcttttgctgtatttttattctcgactccatccaacccagtcggttcttcttgtgaccacgattcgccggaatgtcatgctgagcttttggctcttgagcagcgccaactttgggaacctgtgcgcggccttgtggttggcccctcaggtctcttatgtgtcatccttggcaagttactcggtgggtcacgtcatctctggcatgttatcctacgtttatgcatgcttacagatttggccctttctcttgtttatgtggtgtcccaagggcgttgtcacaagtgttggggaaagtgtataaggacagctcctgctgaggtggctctcaatgtatttcctttctcgcgcgccactcgcaactctctcacatccttgtgtgatcggttccaaactcctaaaggagttgatcccgtgcacttggcaacgggttggcgcgggtgttggcgtggtgagagtcccatccatcaaccacaccaaaagcccatagcttatgccaatttggatgaaaagaaaatatctgctcaaacggtggttgctgtcccatacgaccccagtcaggctatcaaatgtctgaaggttctgcaggcgggaggggctatcgtggaccagcctacgcctgaagttgttcgtgtgtctgaaatccccttttcagccccatttttcccaaaagttccagtcaacccagattgcaggattgtggtggattcagatacttttgtggctgcagtccgctgcggttactcgacagcacaactggtcctaggccggggcaactttgccaagttgaatcagaccccccttagggactctgcctccaccaaaacgactggtggggcctcttatactcttgctgtggctcaagtgtctgtgtggactcttgttcatttcatcctcggtctttggttcacatcacctcaagtgtgtggccgaggaaccgctgacccatggtgttcaaatcccttttcgtatcctgcctacggccctggagttgtgtgctcctctcgactttgtgtgtctgccgatggggtcaccctgccattgttctcagctgtggcacaactctccggtagagaggtagggatttttattttagtgcttgtttccttgactgccttggcccatcgcctggctcttaaggcagacatgttagtggtcttttcagctttttgtgcttacgcctggcccatgagctcctggttaatctgcttctttcctatactcttaaagtgggttacccttcaccccctcactatgctttgggtgcactcattcttggtgttttgtatgccagcagccggcatcctctcactagggataactggccttctctgggcagttggccgctttacccaggttgccggaattattacaccttatgacatccaccagtatacctctgggccacgtggtgcagccgctgtagccacagccccagaaggcacttatatggccgccgtccggagagctgctttaactggacgaactttgatcttcaccccgtctgcggtcggatcccttcttgaataggcggccgcctcgagggatcctctactagagtcgaggcggctgctaacaaagccccaaaggaagctgagttggctgctgccaccgctgagcaataactagcataaccccttggggcctctaaacgggtcttgaggggttttttgctgaaaggaggaactatatccggatcgagatccccaattctgtgagcgtatggcaaacgaaggaaaaatagttatagtagccgcactcgatgggacatttcaacgtaaaccgtttaataattcgaggagcttttgttccctttagtgagggttaatttcgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattccgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagatccttgaagacaaacaacgtctgtagcgaccctttgcaggcagcggaaccccccacctggcgacaggtgcctctgcggccaaaagccacgtgtataagatacacctgcaaaggcggcacaac

SEQ ID NO: 9 - DNA, 7883 bp, Porcine reproductive and respiratory syndrome virus
cccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgataataccatggctgccggcaaacgggctcgtgccaaacgtgccaccaaaagtgggaaggattcggccctcgctcccaagattgccccaccggtccccacctgtggaatcaccacctactctccaccgacagacgggtcttgtggttggcacgttcttgccgccatagtgaatcggatgataaacggtgactttacgtcccccctgcctcagtacaacagaccagaggatgattgggcttctgattatgatcttgctcaggcgattcaatgtttacaactgcctgccaccgtggttcggaatcgcgcctgtcctaacgccaagtacctcataaagctaaacggggttcactgggaagtagaggtgagatctggaatggctcctcgttccctttctcgtgaatgtgtagttggcgtttgctctgaaggctgtgtcgcaccgccttatccagcggacgggcttcctaaacgtgcactcgaggccttggcgtctgcctacagactaccctcagattgtgttagctctggtattgctgactttcttgctgatccacctcctcaggaattctggactctcgacaaaatgttgacctccccgtcaccggagcggtccggcttctccagcttgtataaattactcttagaggttgttccgcaaaaatgtggtgctacggaaggggctttcgtctatgctgttgagaggatgttaaaggactgtccgagccccgaacaggcgatggcccttctggcaaaaattaaagttccatcctcaaaggccccgtctgtgtccttggacgagtgttttcctgcgggtgttccagccgacttcgagccagcatttcaggaaaggccccaaagtcccggtgctgctgtcgccctgtgttcaccggacgcaaaagggttcgagggaacagcctcggaagaagctcaagagagtggccataaggccgtccacgctgtaccccttgccgaaggtcccaataatgaacaggtacaggtggttgctggtgagcagctagagctcggcggttgtggtttggcaatcgggagtgctcagtcctcttcagactccaagagagaaaacatgcacaatagccgggaagacgaaccattggatttgtcccacccagcaccggctgccacgacgacccttgtgggagagcaaacacccgacaacccaggttctgatgccagtgctctccccatcgccgttcgaggatttgtcccgacagggcccatactccgtcatgttgagcactgcggcacagagtcaggcgacagcagttcgcctttggatctgtcttttgcgcaaacgttggaccagcctttagatctatccttggccgcttggccggtgaaggccaccgcgtctgatcctggctgggtccgcggtaggtgcgagcctgtctttttaaagcctcggaaagctttctctgatggcgattcggcccttcagttcggggagctttctgagtccagctctgtcatcgagtttgaccagacaaaagatactctggtggctgacgcccctgttgacttgacgacttcgaacgaggccctctctgcagtcgacccttccgaatttgtcgaactcaggcgcccgcgtcattccgcacaagccttaattgaccgaggcggtccacttgctgatgtccatgcgaaaataaagaaccgggtgtatgaacagtgcctccaagcttgtgagcctggtagtcgtgcaaccccagccaccagggagtggctcgacaaaatgtgggatagggtggacatgaaaacttggcgctgcacttcacagttccaggccggtcgcattcttgcgtccctcaaatttcttcctgacatgattcaagacacgccgcctcctgtccccaagaagaaccgagctagtgacagtgccggtctgaagcaactggtggcacggtgggataagaaattgagtgtaaccccccccccaaaatcggctgggttagtgcttgaccagaccgtccctccgcctacggatatccagcaagaggatgccaccccctccgacgggttatcccatgcatcggatttttctagtcgagtgagcacgagctggagttggaaaggccttatgctttccggcacccgtctcgcggggtctgctggtcagcgcctcatgacatgggtttttgaagtttactcccatctcccagcttttatactcacacttttctcgccgcggggctctatggctccaggcgattggttgtttgcaggtgttgttttacttgctctcttgctctgtcgttcttacccaatactcggatgccttcccttactgggtgtcttctctggttctttgcggcgtgttcgtctgggtgtttttggttcttggatggcttttgctgtatttttattctcgactccatccaacccagtcggttcttcttgtgaccacgattcgccggaatgtcatgctgagcttttggctcttgagcagcgccaactttgggaacctgtgcgcggccttgtggttggcccctcaggtctcttatgtgtcatccttggcaagttactcggtgggtcacgtcatctctggcatgttatcctacgtttatgcatgcttacagatttggccctttctcttgtttatgtggtgtcccaagggcgttgtcacaagtgttggggaaagtgtataaggacagctcctgctgaggtggctctcaatgtatttcctttctcgcgcgccactcgcaactctctcacatccttgtgtgatcggttccaaactcctaaaggagttgatcccgtgcacttggcaacgggttggcgcgggtgttggcgtggtgagagtcccatccatcaaccacaccaaaagcccatagcttatgccaatttggatgaaaagaaaatatctgctcaaacggtggttgctgtcccatacgaccccagtcaggctatcaaatgtctgaaggttctgcaggcgggaggggctatcgtggaccagcctacgcctgaagttgttcgtgtgtctgaaatccccttttcagccccatttttcccaaaagttccagtcaacccagattgcaggattgtggtggattcagatacttttgtggctgcagtccgctgcggttactcgacagcacaactggtcctaggccggggcaactttgccaagttgaatcagaccccccttagggactctgcctccaccaaaacgactggtggggcctcttatactcttgctgtggctcaagtgtctgtgtggactcttgttcatttcatcctcggtctttggttcacatcacctcaagtgtgtggccgaggaaccgctgacccttggtgttcaaatcccttttcgtatcctgcctacggccctggagttgtgtgctcctctcgactttgtgtgtctgccgatggggtcaccctgccattgttctcagctgtggcacaactctccggtagagaggtagggatttttattttagtgcttgtttccttgactgccttggcccatcgcctggctcttaaggcagacatgttagtggtcttttcagctttttgtgcttacgcctggcccatgagctcctggttaatctgcttctttcctatactcttaaagtgggttacccttcaccccctcactatgctttgggtgcactcattcttggtgttttgtatgccagcagccggcatcctctcactagggataactggccttctctgggcagttggccgctttacccaggttgccggaattattacaccttatgacatccaccagtatacctctgggccacgcggtgcagccgctgtagccacagccccagaaggcacttatatggccgccgtccggagagctgctttaactggacgaactttgatcttcaccccgtctgcggtcggatcccttcttgaataggcggccgcctcgagggatcctctactagagtcgaggcggctgctaacaaagccccaaaggaagctgagttggctgctgccaccgctgagcaataactagcataaccccttggggcctctaaacgggtcttgaggggttttttgctgaaaggaggaactatatccggatcgagatccccaattctgtgagcgtatggcaaacgaaggaaaaatagttatagtagccgcactcgatgggacatttcaacgtaaaccgtttaataattcgaggagcttttgttccctttagtgagggttaatttcgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattccgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagatccttgaagacaaacaacgtctgtagcgaccctttgcaggcagcggaaccccccacctggcgacaggtgcctctgcggccaaaagccacgtgtataagatacacctgcaaaggcggcacaac

SEQ ID NO: 10 - DNA, 7885 bp, Porcine reproductive and respiratory syndrome virus
cccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgataataccatggctgccggcaaacgggctcgtgccaaacgtgccaccaaaagtgggaaggattcggccctcgctcccaagattgccccaccggtccccacctgtggaatcaccacctactctccaccgacagacgggtcttgtggttggcacgttcttgccgccatagtgaatcggatgataaacggtgactttacgtcccccctgcctcagtacaacagaccagaggatgattgggcttctgattatgatcttgctcaggcgattcaatgtttacaactgcctgccaccgtggttcggaatcgcgcctgtcctaacgccaagtacctcataaagctaaacggggttcactgggaagtagaggtgagatctggaatggctcctcgttccctttctcgtgaatgtgtagttggcgtttgctctgaaggctgtgtcgcaccgccttatccagcggacgggcttcctaaacgtgcactcgaggccttggcgtctgcctacagactaccctcagattgtgttagctctggtattgctgactttcttgctgatccacctcctcaggaattctggactctcgacaaaatgttgacctccccgtcaccggagcggtccggcttctccagcttgtataaattactcttagaggttgttccgcaaaaatgtggtgctacggaaggggctttcgtctatgctgttgagaggatgttaaaggactgtccgagccccgaacaggcgatggcccttctggcaaaaattaaagttccatcctcaaaggccccgtctgtgtccttggacgagtgttttcctgcgggtgttccagccgacttcgagccagcatttcaggaaaggccccaaagtcccggtgctgctgtcgccctgtgttcaccggacgcaaaagggttcgagggaacagcctcggaagaagctcaagagagtggccataaggccgtccacgctgtaccccttgccgaaggtcccaataatgaacaggtacaggtggttgctggtgagcagctagagctcggcggttgtggtttggcaatcgggagtgctcagtcctcttcagactccaagagagaaaacatgcacaatagccgggaagacgaaccattggatttgtcccacccagcaccggctgccacgacgacccttgtgggagagcaaacacccgacaacccaggttctgatgccagtgctctccccatcgccgttcgaggatttgtcccgacagggcccatactccgtcatgttgagcactgcggcacagagtcaggcgacagcagttcgcctttggatctgtcttttgcgcaaacgttggaccagcctttagatctatccttggccgcttggccggtgaaggccaccgcgtctgatcctggctgggtccgcggtaggtgcgagcctgtctttttaaagcctcggaaagctttctctgatggcgattcggcccttcagttcggggagctttctgagtccagctctgtcatcgagtttgaccagacaaaagatactctggtggctgacgcccctgttgacttgacgacttcgaacgaggccctctctgcagtcgacccttccgaatttgtcgaactcaggcgcccgcgtcattccgcacaagccttaattgaccgaggcggtccacttgctgatgtccatgcgaaaataaagaaccgggtgtatgaacagtgcctccaagcttgtgagcctggtagtcgtgcaaccccagccaccagggagtggctcgacaaaatgtgggatagggtggacatgaaaacttggcgctgcacttcacagttccaggccggtcgcattcttgcgtccctcaaatttcttcctgacatgattcaagacacgccgcctcctgtccccaagaagaaccgagctagtgacagtgccggtctgaagcaactggtggcacggtgggataagaaattgagtgtaaccccccccccaaaatcggctgggttagtgcttgaccagaccgtccctccgcctacggatatccagcaagaggatgccaccccctccgacgggttatcccatgcatcggatttttctagtcgagtgagcacgagctggagttggaaaggccttatgctttccggcacccgtctcgcggggtctgctggtcagcgcctcatgacatgggtgttcttgaagtttactcccatctcccagcttttatactcacacttttctcgccgcggggctctatggctccaggcgattggttgtttgcaggtgttgttttacttgctctcttgctctgtcgttcttacccaatactcggatgccttcccttactgggtgtcttctctggttctttgcggcgtgttcgtctgggtgtttttggttcttggatggcttttgctgtatttttattctcgactccatccaacccagtcggttcttcttgtgaccacgattcgccggaatgtcatgctgagcttttggctcttgagcagcgccaactttgggaacctgtgcgcggccttgtggttggcccctcaggtctcttatgtgtcatccttggcaagttactcggtgggtcacgtcatctctggcatgttatcctacgtttatgcatgcttacagatttggccctttctcttgtttatgtggtgtcccaagggcgttgtcacaagtgttggggaaagtgtataaggacagctcctgctgaggtggctctcaatgtatttcctttctcgcgcgccactcgcaactctctcacatccttgtgtgatcggttccaaactcctaaaggagttgatcccgtgcacttggcaacgggttggcgcgggtgttggcgtggtgagagtcccatccatcaaccacaccaaaagcccatagcttatgccaatttggatgaaaagaaaatatctgctcaaacggtggttgctgtcccatacgaccccagtcaggctatcaaatgtctgaaggttctgcaggcgggaggggctatcgtggaccagcctacgcctgaagttgttcgtgtgtctgaaatccccttttcagccccatttttcccaaaagttccagtcaacccagattgcaggattgtggtggattcagatacttttgtggctgcagtccgctgcggttactcgacagcacaactggtcctaggccggggcaactttgccaagttgaatcagaccccccttagggactctgcctccaccaaaacgactggtggggcctcttatactcttgctgtggctcaagtgtctgtgtggactcttgttcatttcatcctcggtctttggttcacatcacctcaagtgtgtggccgaggaaccgctgacccttggtgttcaaatcccttttcgtatcctgcctacggccctggagttgtgtgctcctctcgactttgtgtgtctgccgatggggtcaccctgccattgttctcagctgtggcacaactctccggtagagaggtagggatttttattttagtgcttgtttccttgactgccttggcccatcgcctggctcttaaggcagacatgttagtggtcttttcagctttttgtgcttacgcctggcccatgagctcctggttaatctgcttctttcctatactcttaaagtgggttacccttcaccccctcactatgctttgggtgcactcattcttggtgttttgtatgccagcagccggcatcctctcactagggataactggccttctctgggcagttggccgctttacccaggttgccggaattattacaccttatgacatccaccagtatacctctgggccacgcggtgcagccgctgtagccacagccccagaaggcacttatatggccgccgtccggagagctgctttaactggacgaactttgatcttcaccccgtctgcggtcggatcccttcttgaataggcggccgcctcgagggatcctctactagagtcgaggcggctgctaacaaagccccaaaggaagctgagttggctgctgccaccgctgagcaataactagcataaccccttggggcctctaaacgggtcttgaggggttttttgctgaaaggaggaactatatccggatcgagatccccaattctgtgagcgtatggcaaacgaaggaaaaatagttatagtagccgcactcgatgggacatttcaacgtaaaccgtttaataattcgaggagcttttgttccctttagtgagggttaatttcgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattccgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagatccttgaagacaaacaacgtctgtagcgaccctttgcaggcagcggaaccccccacctggcgacaggtgcctctgcggccaaaagccacgtgtataagatacacctgcaaaggcggcacaac

SEQ ID NO: 11 - DNA, 4625 bp, Porcine reproductive and respiratory syndrome virus
cccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgataataccatggctgacgtttacaggtggaagaaatttgtgatttttacggactcctctcccaacggtcgatttcgcatgatgtggacgccggaatccgatgactcagccgccctggaggtgctgccgcccgagttagaacgtcaggtcgagatcctcactcggagttttcccgctcatcaccctatcaacctagctgactgggagctcactgagtcccctgagaacggtttttctttcggcacgtcccattcttgcggccacatcgtccagaaccccaacgtgtttgacggcaagtgctggctcacctgctttttgggccaatcggctgaagtgtgctaccacgaggaacatctagctaacgccctcggttaccaaaccaagtggggcgtgcatggtaagtacctccaacgcaggcttcaagtccgcggcatgcgtgctgtggtcgatcctgacggccctattcacgttgaagcgctgtcttgctcccagtcttgggtcaggcacctgactctgaataatgatgtcaccccaggattcgttcgcctgacatccatccgcattgtgtccaacacagaacctaccgctttccggatctttcggtttggagcacataagtggtatggctaggcggccgcctcgagggatcctctactagagtcgaggcggctgctaacaaagccccaaaggaagctgagttggctgctgccaccgctgagcaataactagcataaccccttggggcctctaaacgggtcttgaggggttttttgctgaaaggaggaactatatccggatcgagatccccaattctgtgagcgtatggcaaacgaaggaaaaatagttatagtagccgcactcgatgggacatttcaacgtaaaccgtttaataattcgaggagcttttgttccctttagtgagggttaatttcgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattccgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagatccttgaagacaaacaacgtctgtagcgaccctttgcaggcagcggaaccccccacctggcgacaggtgcctctgcggccaaaagccacgtgtataagatacacctgcaaaggcggcacaac

SEQ ID NO: 12 - DNA, 11146 bp, Porcine reproductive and respiratory syndrome virus
cccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgataataccatggctgggacgttctcccggtgcatgtgcaccccggctgcccgggtattttggaacgccggccaagtcttttgcacacggtgtctcagtgcgcggcctcttctctctccggaacttcaggacactgacctcggtgtagttggattgttttacaagcctaaggacaagattcactggaaagttcctatcggcattcctcaggtggagtgtactccatccgggtgctgctggctctcagccgtattccctttggcgcgcatgacttccggtaatcacaacttcctccaacgacttgttaaggttgctgatgttttgtatcgcgatggttgcttggcgcctcgacacctccgtgaactccaagtttacgagcgcggttgtagctggtacccaattacggggcccgtacccggaatgggtttgtttgcgaactccatgcacgtgtctgaccagccgttccctggtgccacccatgtgttgactaactcgcctctgcctcagcgggcgtgccggcagccgttctgtccatttgaggaagctcattctgacgtttacaggtggaagaaatttgtgatttttacggactcctctcccaacggtcgatttcgcatgatgtggacgccggaatccgatgactcagccgccctggaggtgctgccgcccgagttagaacgtcaggtcgagatcctcactcggagttttcccgctcatcaccctatcaacctagctgactgggagctcactgagtcccctgagaacggtttttctttcggcacgtcccattcttgcggccacatcgtccagaaccccaacgtgtttgacggcaagtgctggctcacctgctttttgggccaatcggctgaagtgtgctaccacgaggaacatctagctaacgccctcggttaccaaaccaagtggggcgtgcatggtaagtacctccaacgcaggcttcaagtccgcggcatgcgtgctgtggtcgatcctgacggccctattcacgttgaagcgctgtcttgctcccagtcttgggtcaggcacctgactctgaataatgatgtcaccccaggattcgttcgcctgacatccatccgcattgtgtccaacacagaacccaccgctttccggatctttcggtttggagcacataagtggtatggcgctgccggcaaacgggctcgtgccaaacgtgccaccaaaagtgggaaggattcggccctcgctcccaagattgccccaccggtccccacctgtggaatcaccacctactctccaccgacagacgggtcttgtggttggcacgttcttgccgccatagtgaatcggatgataaacggtgactttacgtcccccctgcctcagtacaacagaccagaggatgattgggcttctgattatgatcttgctcaggcgattcaatgtttacaactgcctgccaccgtggttcggaatcgcgcctgtcctaacgccaagtacctcataaagctaaacggggttcactgggaagtagaggtgagatctggaatggctcctcgttccctttctcgtgaatgtgtagttggcgtttgctctgaaggctgtgtcgcaccgccttatccagcggacgggcttcctaaacgtgcactcgaggccttggcgtctgcctacagactaccctcagattgtgttagctctggtattgctgactttcttgctgatccacctcctcaggaattctggactctcgacaaaatgttgacctccccgtcaccggagcggtccggcttctccagcttgtataaattactcttagaggttgttccgcaaaaatgtggtgctacggaaggggctttcgtctatgctgttgagaggatgttaaaggactgtccgagccccgaacaggcgatggcccttctggcaaaaattaaagttccatcctcaaaggccccgtctgtgtccttggacgagtgttttcctgcgggtgttccagccgacttcgagccagcatttcaggaaaggccccaaagtcccggtgctgctgtcgccctgtgttcaccggacgcaaaagggttcgagggaacagcctcggaagaagctcaagagagtggccataaggccgtccacgctgtaccccttgccgaaggtcccaataatgaacaggtacaggtggttgctggtgagcagctagagctcggcggttgtggtttggcaatcgggagtgctcagtcctcttcagactccaagagagaaaacatgcacaatagccgggaagacgaaccattggatttgtcccacccagcaccggctgccacgacgacccttgtgggagagcaaacacccgacaacccaggttctgatgccagtgctctccccatcgccgttcgaggatttgtcccgacagggcccatactccgtcatgttgagcactgcggcacagagtcaggcgacagcagttcgcctttggatctgtcttttgcgcaaacgttggaccagcctttagatctatccttggccgcttggccggtgaaggccaccgcgtctgatcctggctgggtccgcggtaggtgcgagcctgtctttttaaagcctcggaaagctttctctgatggcgattcggcccttcagttcggggagctttctgagtccagctctgtcatcgagtttgaccagacaaaagatactctggtggctgacgcccctgttgacttgacgacttcgaacgaggccctctctgcagtcgacccttccgaatttgtcgaactcaggcgcccgcgtcattccgcacaagccttaattgaccgaggcggtccacttgctgatgtccatgcgaaaataaagaaccgggtgtatgaacagtgcctccaagcttgtgagcctggtagtcgtgcaaccccagccaccagggagtggctcgacaaaatgtgggatagggtggacatgaaaacttggcgctgcacttcacagttccaggccggtcgcattcttgcgtccctcaaatttcttcctgacatgattcaagacacgccgcctcctgtccccaagaagaaccgagctagtgacagtgccggtctgaagcaactggtggcacggtgggataagaaattgagtgtaaccccccccccaaaatcggctgggttagtgcttgaccagaccgtccctccgcctacggatatccagcaagaggatgccaccccctccgacgggttatcccatgcatcggatttttctagtcgagtgagcacgagctggagttggaaaggccttatgctttccggcacccgtctcgcggggtctgctggtcagcgcctcatgacatgggtgttcttgaagtttactcccatctcccagcttttatactcacacttttctcgccgcggggctctatggctccaggcgattggttgtttgcaggtgttgttttacttgctctcttgctctgtcgttcttacccaatactcggatgccttcccttactgggtgtcttctctggttctttgcggcgtgttcgtctgggtgtttttggttcttggatggcttttgctgtatttttattctcgactccatccaacccagtcggttcttcttgtgaccacgattcgccggaatgtcatgctgagcttttggctcttgagcagcgccaactttgggaacctgtgcgcggccttgtggttggcccctcaggtctcttatgtgtcatccttggcaagttactcggtgggtcacgtcatctctggcatgttatcctacgtttatgcatgcttacagatttggccctttctcttgtttatgtggtgtcccaagggcgttgtcacaagtgttggggaaagtgtataaggacagctcctgctgaggtggctctcaatgtatttcctttctcgcgcgccactcgcaactctctcacatccttgtgtgatcggttccaaactcctaaaggagttgatcccgtgcacttggcaacgggttggcgcgggtgttggcgtggtgagagtcccatccatcaaccacaccaaaagcccatagcttatgccaatttggatgaaaagaaaatatctgctcaaacggtggttgctgtcccatacgaccccagtcaggctatcaaatgtctgaaggttctgcaggcgggaggggctatcgtggaccagcctacgcctgaagttgttcgtgtgtctgaaatccccttttcagccccatttttcccaaaagttccagtcaacccagattgcaggattgtggtggattcagatacttttgtggctgcagtccgctgcggttactcgacagcacaactggtcctaggccggggcaactttgccaagttgaatcagaccccccttagggactctgcctccaccaaaacgactggtggggcctcttatactcttgctgtggctcaagtgtctgtgtggactcttgttcatttcatcctcggtctttggttcacatcacctcaagtgtgtggccgaggaaccgctgacccttggtgttcaaatcccttttcgtatcctgcctacggccctggagttgtgtgctcctctcgactttgtgtgtctgccgatggggtcaccctgccattgttctcagctgtggcacaactctccggtagagaggtagggatttttattttagtgcttgtttccttgactgccttggcccatcgcctggctcttaaggcagacatgttagtggtcttttcagctttttgtgcttacgcctggcccatgagctcctggttaatctgcttctttcctatactcttaaagtgggttacccttcaccccctcactatgctttgggtgcactcattcttggtgttttgtatgccagcagccggcatcctctcactagggataactggccttctctgggcagttggccgctttacccaggttgccggaattattacaccttatgacatccaccagtatacctctgggccacgcggtgcagccgctgtagccacagccccagaaggcacttatatggccgccgtccggagagctgctttaactggacgaactttgatcttcaccccgtctgcggtcggatcccttcttgaaggtgctttcaggactcataaaccctgccttaacaccgtgaatgttgtgggttcttcccttggttctggaggggtttttaccattgatggcagaaagaccgtcgtcactgctgctcatgtgttgaacggcgacacagctagagttaccggcgactcttacaaccgcatgcacacttttaagaccagtggcgattatgcctggtcccatgctgatgactggcagggcgttgcccctgtggtcaaggttgcgaaggggtatcgcggtcgtgcctactggcaaacatcaaccggtgtcgaacccggcgtcattggggaagggttcgccttctgtttcaccaactgtggcgattcggggtcacccgtcatctcagaatctggtgatctcatcggaatccataccggttcaaacaaactcggttctggtcttgtgacgacccctgaaggggaaacctgcgccatcaaagaaaccaagctctctgacctttccagacattttgcgggcccgagcgtccctcttggggacattaaattgagtccggccatcgtccctgatgtaacatctattccgagtgacttggcatcgctcctagcttccgtccctgtaatggaaggcggcctctcgaccgttcaacttctgtgtgtctttttccttctctggcgcatgatgggccatgcctggacacccattgttgccgtgggcttctttttgctgaatgaaattcttccagcagttttggtccgagccgtgttttcctttgcactctttattcttgcatgggccaccccctggtccgcacaggtgttaatgattagactcctcacggcatccctcaaccgcaacaagttgtctctggcgttctacgcacttgggggtgtcgtcggtttggccgctgaaatcggggcttttgccggcaggctgcctgaattgtctcaagctctttcgacatactgtttcttacctagggtccttgccatggccagttatgttcccatcatcatcattggtggactccatgccctcggtgtgattctgtggttgttcaaataccggtgcctccacaacatgctggttggtgatgggagtttctcaagcgctttcttcctacggtattttgcagagggtaatcttagaaaaggtgtttcacagtcttgtggcatgagtaacgagtccctgacggctgctctagcttgcaagttgtcgcaggctgaccttgactttttgtccagcttaacgaacttcaagtgctttgtatctgcttcaaacatgaaaaatgctgccggccagtatattgaagcagcgtatgccaaggccctgcgccaagagttggcctccctagttcaggttgacaaaatgaaaggaattttgtctaagcttgaggcctttgctgaaacagccactccgtcccttgacgcaggtgacgtggttgttctgcttgggcaacatcctcacggatccatcctcgatattaatgtggggactgaaaggaaaactgtgtccgtgcaagagacccggagcttaggtggttccaaattcagtgtttgcactgtcgtgtccaacacacccgtggacgccttaactggcatcccactccagacaccaacccctctttttgagaatggtccgcgtcaccgtggtgaggaagacgatcttagagtcgagaggatgaagaaacactgtgtgtccctcggcttccacaacattaatggcaaagtttactgcaaaatttgggacaagtccaccggtgataccttttataccgatgattcccggtacacccaagaccttgcattccaggacaggtcagccgactacagagacagggattatgagggtgtgcaaaccgccccccaacagggctttgatccaaagtctgaaacccctattggcactgtggtgatcggcggtatcacgtataacaggtacctgatcaaaggtaaggaggtcttggttcccaagcctgacaactgccttgaagctgccaagctgtcccttgagcaagctctcgctgggatgggccaaacttgcgaccttacagctgccgaggtggaaaagttgaggcgcatcattagccagctccaaggtttgaccactgaacaggctttaaactgttaggcggccgcctcgagggatcctctactagagtcgaggcggctgctaacaaagccccaaaggaagctgagttggctgctgccaccgctgagcaataactagcataaccccttggggcctctaaacgggtcttgaggggttttttgctgaaaggaggaactatatccggatcgagatccccaattctgtgagcgtatggcaaacgaaggaaaaatagttatagtagccgcactcgatgggacatttcaacgtaaaccgtttaataattcgaggagcttttgttccctttagtgagggttaatttcgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattccgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagatccttgaagacaaacaacgtctgtagcgaccctttgcaggcagcggaaccccccacctggcgacaggtgcctctgcggccaaaagccacgtgtataagatacacctgcaaaggcggcacaac

SEQ ID NO: 13 - DNA, 11144 bp, Porcine reproductive and respiratory syndrome virus
cccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgataataccatggctgggacgttctcccggtgcatgtgcaccccggctgcccgggtattttggaacgccggccaagtcttttgcacacggtgtctcagtgcgcggcctcttctctctccggaacttcaggacactgacctcggtgtagttggattgttttacaagcctaaggacaagattcactggaaagttcctatcggcattcctcaggtggagtgtactccatccgggtgctgctggctctcagccgtattccctttggcgcgcatgacttccggtaatcacaacttcctccaacgacttgttaaggttgctgatgttttgtatcgcgatggttgcttggcgcctcgacacctccgtgaactccaagtttacgagcgcggttgtagctggtacccaattacggggcccgtacccggaatgggtttgtttgcgaactccatgcacgtgtctgaccagccgttccctggtgccacccatgtgttgactaactcgcctctgcctcagcgggcgtgccggcagccgttctgtccatttgaggaagctcattctgacgtttacaggtggaagaaatttgtgatttttacggactcctctcccaacggtcgatttcgcatgatgtggacgccggaatccgatgactcagccgccctggaggtgctgccgcccgagttagaacgtcaggtcgagatcctcactcggagttttcccgctcatcaccctatcaacctagctgactgggagctcactgagtcccctgagaacggtttttctttcggcacgtcccattcttgcggccacatcgtccagaaccccaacgtgtttgacggcaagtgctggctcacctgctttttgggccaatcggctgaagtgtgctaccacgaggaacatctagctaacgccctcggttaccaaaccaagtggggcgtgcatggtaagtacctccaacgcaggcttcaagtccgcggcatgcgtgctgtggtcgatcctgacggccctattcacgttgaagcgctgtcttgctcccagtcttgggtcaggcacctgactctgaataatgatgtcaccccaggattcgttcgcctgacatccatccgcattgtgtccaacacagaacccaccgctttccggatctttcggtttggagcacataagtggtatggcgctgccggcaaacgggctcgtgccaaacgtgccaccaaaagtgggaaggattcggccctcgctcccaagattgccccaccggtccccacctgtggaatcaccacctactctccaccgacagacgggtcttgtggttggcacgttcttgccgccatagtgaatcggatgataaacggtgactttacgtcccccctgcctcagtacaacagaccagaggatgattgggcttctgattatgatcttgctcaggcgattcaatgtttacaactgcctgccaccgtggttcggaatcgcgcctgtcctaacgccaagtacctcataaagctaaacggggttcactgggaagtagaggtgagatctggaatggctcctcgttccctttctcgtgaatgtgtagttggcgtttgctctgaaggctgtgtcgcaccgccttatccagcggacgggcttcctaaacgtgcactcgaggccttggcgtctgcctacagactaccctcagattgtgttagctctggtattgctgactttcttgctgatccacctcctcaggaattctggactctcgacaaaatgttgacctccccgtcaccggagcggtccggcttctccagcttgtataaattactcttagaggttgttccgcaaaaatgtggtgctacggaaggggctttcgtctatgctgttgagaggatgttaaaggactgtccgagccccgaacaggcgatggcccttctggcaaaaattaaagttccatcctcaaaggccccgtctgtgtccttggacgagtgttttcctgcgggtgttccagccgacttcgagccagcatttcaggaaaggccccaaagtcccggtgctgctgtcgccctgtgttcaccggacgcaaaagggttcgagggaacagcctcggaagaagctcaagagagtggccataaggccgtccacgctgtaccccttgccgaaggtcccaataatgaacaggtacaggtggttgctggtgagcagctagagctcggcggttgtggtttggcaatcgggagtgctcagtcctcttcagactccaagagagaaaacatgcacaatagccgggaagacgaaccattggatttgtcccacccagcaccggctgccacgacgacccttgtgggagagcaaacacccgacaacccaggttctgatgccagtgctctccccatcgccgttcgaggatttgtcccgacagggcccatactccgtcatgttgagcactgcggcacagagtcaggcgacagcagttcgcctttggatctgtcttttgcgcaaacgttggaccagcctttagatctatccttggccgcttggccggtgaaggccaccgcgtctgatcctggctgggtccgcggtaggtgcgagcctgtctttttaaagcctcggaaagctttctctgatggcgattcggcccttcagttcggggagctttctgagtccagctctgtcatcgagtttgaccagacaaaagatactctggtggctgacgcccctgttgacttgacgacttcgaacgaggccctctctgcagtcgacccttccgaatttgtcgaactcaggcgcccgcgtcattccgcacaagccttaattgaccgaggcggtccacttgctgatgtccatgcgaaaataaagaaccgggtgtatgaacagtgcctccaagcttgtgagcctggtagtcgtgcaaccccagccaccagggagtggctcgacaaaatgtgggatagggtggacatgaaaacttggcgctgcacttcacagttccaggccggtcgcattcttgcgtccctcaaatttcttcctgacatgattcaagacacgccgcctcctgtccccaagaagaaccgagctagtgacagtgccggtctgaagcaactggtggcacggtgggataagaaattgagtgtaaccccccccccaaaatcggctgggttagtgcttgaccagaccgtccctccgcctacggatatccagcaagaggatgccaccccctccgacgggttatcccatgcatcggatttttctagtcgagtgagcacgagctggagttggaaaggccttatgctttccggcacccgtctcgcggggtctgctggtcagcgcctcatgacatgggtttttgaagtttactcccatctcccagcttttatactcacacttttctcgccgcggggctctatggctccaggcgattggttgtttgcaggtgttgttttacttgctctcttgctctgtcgttcttacccaatactcggatgccttcccttactgggtgtcttctctggttctttgcggcgtgttcgtctgggtgtttttggttcttggatggcttttgctgtatttttattctcgactccatccaacccagtcggttcttcttgtgaccacgattcgccggaatgtcatgctgagcttttagctctagagcagcgccaactttgggaacctgtgcgcggccttgtggttggcccctcaggtctcttatgtgtcatccttggcaagttactcggtgggtcacgtcatctctggcatgttatcctacgtttatgcatgcttacagatttggccctttctcttgtttatgtggtgtcccaagggcgttgtcacaagtgttggggaaagtgtataaggacagctcctgctgaggtggctctcaatgtatttcctttctcgcgcgccactcgcaactctctcacatccttgtgtgatcggttccaaactcctaaaggagttgatcccgtgcacttggcaacgggttggcgcgggtgttggcgtggtgagagtcccatccatcaaccacaccaaaagcccatagcttatgccaatttggatgaaaagaaaatatctgctcaaacggtggttgctgtcccatacgaccccagtcaggctatcaaatgtctgaaggttctgcaggcgggaggggctatcgtggaccagcctacgcctgaagttgttcgtgtgtctgaaatccccttttcagccccatttttcccaaaagttccagtcaacccagattgcaggattgtggtggattcagatacttttgtggctgcagtccgctgcggttactcgacagcacaactggtcctaggccggggcaactttgccaagttgaatcagaccccccttagggactctgcctccaccaaaacgactggtggggcctcttatactcttgctgtggctcaagtgtctgtgtggactcttgttcatttcatcctcggtctttggttcacatcacctcaagtgtgtggccgaggaaccgctgacccttggtgttcaaatcccttttcgtatcctgcctacggccctggagttgtgtgctcctctcgactttgtgtgtctgccgatggggtcaccctgccattgttctcagctgtggcacaactctccggtagagaggtagggatttttattttagtgcttgtttccttgactgccttggcccatcgcctggctcttaaggcagacatgttagtggtcttttcagctttttgtgcttacgcctggcccatgagctcctggttaatctgcttctttcctatactcttaaagtgggttacccttcaccccctcactatgctttgggtgcactcattcttggtgttttgtatgccagcagccggcatcctctcactagggataactggccttctctgggcagttggccgctttacccaggttgccggaattattacaccttatgacatccaccagtatacctctgggccacgcggtgcagccgctgtagccacagccccagaaggcacttatatggccgccgtccggagagctgctttaactggacgaactttgatcttcaccccgtctgcggtcggatcccttcttgaaggtgctttcaggactcataaaccctgccttaacaccgtgaatgttgtgggttcttcccttggttctggaggggtttttaccattgatggcagaaagaccgtcgtcactgctgctcatgtgttgaacggcgacacagctagagttaccggcgactcttacaaccgcatgcacacttttaagaccagtggcgattatgcctggtcccatgctgatgactggcagggcgttgcccctgtggtcaaggttgcgaaggggtatcgcggtcgtgcctactggcaaacatcaaccggtgtcgaacccggcgtcattggggaagggttcgccttctgtttcaccaactgtggcgattcggggtcacccgtcatctcagaatctggtgatctcatcggaatccataccggttcaaacaaactcggttctggtcttgtgacgacccctgaaggggaaacctgcgccatcaaagaaaccaagctctctgacctttccagacattttgcgggcccgagcgtccctcttggggacattaaattgagtccggccatcgtccctgatgtaacatctattccgagtgacttggcatcgctcctagcttccgtccctgtaatggaaggcggcctctcgaccgttcaacttctgtgtgtctttttccttctctggcgcatgatgggccatgcctggacacccattgttgccgtgggcttctttttgctgaatgaaattcttccagcagttttggtccgagccgtgttttcctttgcactctttattcttgcatgggccaccccctggtccgcacaggtgttaatgattagactcctcacggcatccctcaaccgcaacaagttgtctctggcgttctacgcacttgggggtgtcgtcggtttggccgctgaaatcggggcttttgccggcaggctgcctgaattgtctcaagctctttcgacatactgtttcttacctagggtccttgcgatggccagttatgttcccatcatcatcattggtggactccatgccctcggtgtgattctgtggttgttcaaataccggtgcctccacaacatgctggttggtgatgggagtttctcaagcgctttcttcctacggtattttgcagagggtaatcttagaaaaggtgtttcacagtcttgtggcatgagtaacgagtccctgacggctgctctagcttgcaagttgtcgcaggctgaccttgactttttgtccagcttaacgaacttcaagtgctttgtatctgcttcaaacatgaaaaatgctgccggccagtatattgaagcagcgtatgccaaggccctgcgccaagagttggcctccctagttcaggttgacaaaatgaaaggaattttgtctaagcttgaggcctttgctgaaacagccactccgtcccttgacgcaggtgacgtggttgttctgcttgggcaacatcctcacggatccatcctcgatattaatgtggggactgaaaggaaaactgtgtccgtgcaagagacccggagcttaggtggttccaaattcagtgtttgcactgtcgtgtccaacacacccgtggacgccttaactggcatcccactccagacaccaacccctctttttgagaatggtccgcgtcaccgtggtgaggaagacgatcttagagtcgagaggatgaagaaacactgtgtgtccctcggcttccacaacattaatggcaaagtttactgcaaaatttgggacaagtccaccggtgataccttttataccgatgattcccggtacacccaagaccttgcattccaggacaggtcagccgactacagagacagggattatgagggtgtgcaaaccgccccccaacagggctttgatccaaagtctgaaacccctattggcactgtggtgatcggcggtatcacgtataacaggtacctgatcaaaggtaaggaggtcttggttcccaagcctgacaactgccttgaagctgccaagctgtcccttgagcaagctctcgctgggatgggccaaacttgcgaccttacagctgccgaggtggaaaagttgaggcgcatcattagccagctccaaggtttgaccactgaacaggctttaaactgttaggcggccgcctcgagggatcctctactagagtcgaggcggctgctaacaaagccccaaaggaagctgagttggctgctgccaccgctgagcaataactagcataaccccttggggcctctaaacgggtcttgaggggttttttgctgaaaggaggaactatatccggatcgagatccccaattctgtgagcgtatggcaaacgaaggaaaaatagttatagtagccgcactcgatgggacatttcaacgtaaaccgtttaataattcgaggagcttttgttccctttagtgagggttaatttcgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattccgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagatccttgaagacaaacaacgtctgtagcgaccctttgcaggcagcggaaccccccacctggcgacaggtgcctctgcggccaaaagccacgtgtataagatacacctgcaaaggcggcacaac

SEQ ID NO: 14 - DNA, 12 bp, Porcine reproductive and respiratory syndrome virus
ttagctctagag

SEQ ID NO: 15 - DNA, 11144 bp, Porcine reproductive and respiratory syndrome virus
cccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgataataccatggctgggacgttctcccggtgcatgtgcaccccggctgcccgggtattttggaacgccggccaagtcttttgcacacggtgtctcagtgcgcggcctcttctctctccggaacttcaggacactgacctcggtgtagttggattgttttacaagcctaaggacaagattcactggaaagttcctatcggcattcctcaggtggagtgtactccatccgggtgctgctggctctcagccgtattccctttggcgcgcatgacttccggtaatcacaacttcctccaacgacttgttaaggttgctgatgttttgtatcgcgatggttgcttggcgcctcgacacctccgtgaactccaagtttacgagcgcggttgtagctggtacccaattacggggcccgtacccggaatgggtttgtttgcgaactccatgcacgtgtctgaccagccgttccctggtgccacccatgtgttgactaactcgcctctgcctcagcgggcgtgccggcagccgttctgtccatttgaggaagctcattctgacgtttacaggtggaagaaatttgtgatttttacggactcctctcccaacggtcgatttcgcatgatgtggacgccggaatccgatgactcagccgccctggaggtgctgccgcccgagttagaacgtcaggtcgagatcctcactcggagttttcccgctcatcaccctatcaacctagctgactgggagctcactgagtcccctgagaacggtttttctttcggcacgtcccattcttgcggccacatcgtccagaaccccaacgtgtttgacggcaagtgctggctcacctgctttttgggccaatcggctgaagtgtgctaccacgaggaacatctagctaacgccctcggttaccaaaccaagtggggcgtgcatggtaagtacctccaacgcaggcttcaagtccgcggcatgcgtgctgtggtcgatcctgacggccctattcacgttgaagcgctgtcttgctcccagtcttgggtcaggcacctgactctgaataatgatgtcaccccaggattcgttcgcctgacatccatccgcattgtgtccaacacagaacccaccgctttccggatctttcggtttggagcacataagtggtatggcgctgccggcaaacgggctcgtgccaaacgtgccaccaaaagtgggaaggattcggccctcgctcccaagattgccccaccggtccccacctgtggaatcaccacctactctccaccgacagacgggtcttgtggttggcacgttcttgccgccatagtgaatcggatgataaacggtgactttacgtcccccctgcctcagtacaacagaccagaggatgattgggcttctgattatgatcttgctcaggcgattcaatgtttacaactgcctgccaccgtggttcggaatcgcgcctgtcctaacgccaagtacctcataaagctaaacggggttcactgggaagtagaggtgagatctggaatggctcctcgttccctttctcgtgaatgtgtagttggcgtttgctctgaaggctgtgtcgcaccgccttatccagcggacgggcttcctaaacgtgcactcgaggccttggcgtctgcctacagactaccctcagattgtgttagctctggtattgctgactttcttgctgatccacctcctcaggaattctggactctcgacaaaatgttgacctccccgtcaccggagcggtccggcttctccagcttgtataaattactcttagaggttgttccgcaaaaatgtggtgctacggaaggggctttcgtctatgctgttgagaggatgttaaaggactgtccgagccccgaacaggcgatggcccttctggcaaaaattaaagttccatcctcaaaggccccgtctgtgtccttggacgagtgttttcctgcgggtgttccagccgacttcgagccagcatttcaggaaaggccccaaagtcccggtgctgctgtcgccctgtgttcaccggacgcaaaagggttcgagggaacagcctcggaagaagctcaagagagtggccataaggccgtccacgctgtaccccttgccgaaggtcccaataatgaacaggtacaggtggttgctggtgagcagctagagctcggcggttgtggtttggcaatcgggagtgctcagtcctcttcagactccaagagagaaaacatgcacaatagccgggaagacgaaccattggatttgtcccacccagcaccggctgccacgacgacccttgtgggagagcaaacacccgacaacccaggttctgatgccagtgctctccccatcgccgttcgaggatttgtcccgacagggcccatactccgtcatgttgagcactgcggcacagagtcaggcgacagcagttcgcctttggatctgtcttttgcgcaaacgttggaccagcctttagatctatccttggccgcttggccggtgaaggccaccgcgtctgatcctggctgggtccgcggtaggtgcgagcctgtctttttaaagcctcggaaagctttctctgatggcgattcggcccttcagttcggggagctttctgagtccagctctgtcatcgagtttgaccagacaaaagatactctggtggctgacgcccctgttgacttgacgacttcgaacgaggccctctctgcagtcgacccttccgaatttgtcgaactcaggcgcccgcgtcattccgcacaagccttaattgaccgaggcggtccacttgctgatgtccatgcgaaaataaagaaccgggtgtatgaacagtgcctccaagcttgtgagcctggtagtcgtgcaaccccagccaccagggagtggctcgacaaaatgtgggatagggtggacatgaaaacttggcgctgcacttcacagttccaggccggtcgcattcttgcgtccctcaaatttcttcctgacatgattcaagacacgccgcctcctgtccccaagaagaaccgagctagtgacagtgccggtctgaagcaactggtggcacggtgggataagaaattgagtgtaaccccccccccaaaatcggctgggttagtgcttgaccagaccgtccctccgcctacggatatccagcaagaggatgccaccccctccgacgggttatcccatgcatcggatttttctagtcgagtgagcacgagctggagttggaaaggccttatgctttccggcacccgtctcgcggggtctgctggtcagcgcctcatgacatgggtattcgaagtttatagtcatttgccagcttttatactgacacttttctcgccgcggggctctatggctccaggcgattggttgtttgcaggtgttgttttacttgctctcttgctctgtcgttcttacccaatactcggatgccttcccttactgggtgtcttctctggttctttgcggcgtgttcgtctgggtgtttttggttcttggatggcttttgctgtatttttattctcgactccatccaacccagtcggttcttcttgtgaccacgattcgccggaatgtcatgctgagcttttggctcttgagcagcgccaactttgggaacctgtgcgcggccttgtggttggcccctcaggtctcttatgtgtcatccttggcaagttactcggtgggtcacgtcatctctggcatgttatcctacgtttatgcatgcttacagatttggccctttctcttgtttatgtggtgtcccaagggcgttgtcacaagtgttggggaaagtgtataaggacagctcctgctgaggtggctctcaatgtatttcctttctcgcgcgccactcgcaactctctcacatccttgtgtgatcggttccaaactcctaaaggagttgatcccgtgcacttggcaacgggttggcgcgggtgttggcgtggtgagagtcccatccatcaaccacaccaaaagcccatagcttatgccaatttggatgaaaagaaaatatctgctcaaacggtggttgctgtcccatacgaccccagtcaggctatcaaatgtctgaaggttctgcaggcgggaggggctatcgtggaccagcctacgcctgaagttgttcgtgtgtctgaaatccccttttcagccccatttttcccaaaagttccagtcaacccagattgcaggattgtggtggattcagatacttttgtggctgcagtccgctgcggttactcgacagcacaactggtcctaggccggggcaactttgccaagttgaatcagaccccccttagggactctgcctccaccaaaacgactggtggggcctcttatactcttgctgtggctcaagtgtctgtgtggactcttgttcatttcatcctcggtctttggttcacatcacctcaagtgtgtggccgaggaaccgctgacccttggtgttcaaatcccttttcgtatcctgcctacggccctggagttgtgtgctcctctcgactttgtgtgtctgccgatggggtcaccctgccattgttctcagctgtggcacaactctccggtagagaggtagggatttttattttagtgcttgtttccttgactgccttggcccatcgcctggctcttaaggcagacatgttagtggtcttttcagctttttgtgcttacgcctggcccatgagctcctggttaatctgcttctttcctatactcttaaagtgggttacccttcaccccctcactatgctttgggtgcactcattcttggtgttttgtatgccagcagccggcatcctctcactagggataactggccttctctgggcagttggccgctttacccaggttgccggaattattacaccttatgacatccaccagtatacctctgggccacgcggtgcagccgctgtagccacagccccagaaggcacttatatggccgccgtccggagagctgctttaactggacgaactttgatcttcaccccgtctgcggtcggatcccttcttgaaggtgctttcaggactcataaaccctgccttaacaccgtgaatgttgtgggttcttcccttggttctggaggggtttttaccattgatggcagaaagaccgtcgtcactgctgctcatgtgttgaacggcgacacagctagagttaccggcgactcttacaaccgcatgcacacttttaagaccagtggcgattatgcctggtcccatgctgatgactggcagggcgttgcccctgtggtcaaggttgcgaaggggtatcgcggtcgtgcctactggcaaacatcaaccggtgtcgaacccggcgtcattggggaagggttcgccttctgtttcaccaactgtggcgattcggggtcacccgtcatctcagaatctggtgatctcatcggaatccataccggttcaaacaaactcggttctggtcttgtgacgacccctgaaggggaaacctgcgccatcaaagaaaccaagctctctgacctttccagacattttgcgggcccgagcgtccctcttggggacattaaattgagtccggccatcgtccctgatgtaacatctattccgagtgacttggcatcgctcctagcttccgtccctgtaatggaaggcggcctctcgaccgttcaacttctgtgtgtctttttccttctctggcgcatgatgggccatgcctggacacccattgttgccgtgggcttctttttgctgaatgaaattcttccagcagttttggtccgagccgtgttttcctttgcactctttattcttgcatgggccaccccctggtccgcacaggtgttaatgattagactcctcacggcatccctcaaccgcaacaagttgtctctggcgttctacgcacttgggggtgtcgtcggtttggccgctgaaatcggggcttttgccggcaggctgcctgaattgtctcaagctctttcgacatactgtttcttacctagggtccttgcgatggccagttatgttcccatcatcatcattggtggactccatgccctcggtgtgattctgtggttgttcaaataccggtgcctccacaacatgctggttggtgatgggagtttctcaagcgctttcttcctacggtattttgcagagggtaatcttagaaaaggtgtttcacagtcttgtggcatgagtaacgagtccctgacggctgctctagcttgcaagttgtcgcaggctgaccttgactttttgtccagcttaacgaacttcaagtgctttgtatctgcttcaaacatgaaaaatgctgccggccagtatattgaagcagcgtatgccaaggccctgcgccaagagttggcctccctagttcaggttgacaaaatgaaaggaattttgtctaagcttgaggcctttgctgaaacagccactccgtcccttgacgcaggtgacgtggttgttctgcttgggcaacatcctcacggatccatcctcgatattaatgtggggactgaaaggaaaactgtgtccgtgcaagagacccggagcttaggtggttccaaattcagtgtttgcactgtcgtgtccaacacacccgtggacgccttaactggcatcccactccagacaccaacccctctttttgagaatggtccgcgtcaccgtggtgaggaagacgatcttagagtcgagaggatgaagaaacactgtgtgtccctcggcttccacaacattaatggcaaagtttactgcaaaatttgggacaagtccaccggtgataccttttataccgatgattcccggtacacccaagaccttgcattccaggacaggtcagccgactacagagacagggattatgagggtgtgcaaaccgccccccaacagggctttgatccaaagtctgaaacccctattggcactgtggtgatcggcggtatcacgtataacaggtacctgatcaaaggtaaggaggtcttggttcccaagcctgacaactgccttgaagctgccaagctgtcccttgagcaagctctcgctgggatgggccaaacttgcgaccttacagctgccgaggtggaaaagttgaggcgcatcattagccagctccaaggtttgaccactgaacaggctttaaactgttaggcggccgcctcgagggatcctctactagagtcgaggcggctgctaacaaagccccaaaggaagctgagttggctgctgccaccgctgagcaataactagcataaccccttggggcctctaaacgggtcttgaggggttttttgctgaaaggaggaactatatccggatcgagatccccaattctgtgagcgtatggcaaacgaaggaaaaatagttatagtagccgcactcgatgggacatttcaacgtaaaccgtttaataattcgaggagcttttgttccctttagtgagggttaatttcgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattccgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagatccttgaagacaaacaacgtctgtagcgaccctttgcaggcagcggaaccccccacctggcgacaggtgcctctgcggccaaaagccacgtgtataagatacacctgcaaaggcggcacaac

SEQ ID NO: 16 - DNA, 48 bp, Porcine reproductive and respiratory syndrome virus
tgggtattcgaagtttatagtcatttgccagcttttatactgacactt

SEQ ID NO: 17 - DNA, 11144 bp, Porcine reproductive and respiratory syndrome virus
cccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgataataccatggctgggacgttctcccggtgcatgtgcaccccggctgcccgggtattttggaacgccggccaagtcttttgcacacggtgtctcagtgcgcggcctcttctctctccggaacttcaggacactgacctcggtgtagttggattgttttacaagcctaaggacaagattcactggaaagttcctatcggcattcctcaggtggagtgtactccatccgggtgctgctggctctcagccgtattccctttggcgcgcatgacttccggtaatcacaacttcctccaacgacttgttaaggttgctgatgttttgtatcgcgatggttgcttggcgcctcgacacctccgtgaactccaagtttacgagcgcggttgtagctggtacccaattacggggcccgtacccggaatgggtttgtttgcgaactccatgcacgtgtctgaccagccgttccctggtgccacccatgtgttgactaactcgcctctgcctcagcgggcgtgccggcagccgttctgtccatttgaggaagctcattctgacgtttacaggtggaagaaatttgtgatttttacggactcctctcccaacggtcgatttcgcatgatgtggacgccggaatccgatgactcagccgccctggaggtgctgccgcccgagttagaacgtcaggtcgagatcctcactcggagttttcccgctcatcaccctatcaacctagctgactgggagctcactgagtcccctgagaacggtttttctttcggcacgtcccattcttgcggccacatcgtccagaaccccaacgtgtttgacggcaagtgctggctcacctgctttttgggccaatcggctgaagtgtgctaccacgaggaacatctagctaacgccctcggttaccaaaccaagtggggcgtgcatggtaagtacctccaacgcaggcttcaagtccgcggcatgcgtgctgtggtcgatcctgacggccctattcacgttgaagcgctgtcttgctcccagtcttgggtcaggcacctgactctgaataatgatgtcaccccaggattcgttcgcctgacatccatccgcattgtgtccaacacagaacccaccgctttccggatctttcggtttggagcacataagtggtatggcgctgccggcaaacgggctcgtgccaaacgtgccaccaaaagtgggaaggattcggccctcgctcccaagattgccccaccggtccccacctgtggaatcaccacctactctccaccgacagacgggtcttgtggttggcacgttcttgccgccatagtgaatcggatgataaacggtgactttacgtcccccctgcctcagtacaacagaccagaggatgattgggcttctgattatgatcttgctcaggcgattcaatgtttacaactgcctgccaccgtggttcggaatcgcgcctgtcctaacgccaagtacctcataaagctaaacggggttcactgggaagtagaggtgagatctggaatggctcctcgttccctttctcgtgaatgtgtagttggcgtttgctctgaaggctgtgtcgcaccgccttatccagcggacgggcttcctaaacgtgcactcgaggccttggcgtctgcctacagactaccctcagattgtgttagctctggtattgctgactttcttgctgatccacctcctcaggaattctggactctcgacaaaatgttgacctccccgtcaccggagcggtccggcttctccagcttgtataaattactcttagaggttgttccgcaaaaatgtggtgctacggaaggggctttcgtctatgctgttgagaggatgttaaaggactgtccgagccccgaacaggcgatggcccttctggcaaaaattaaagttccatcctcaaaggccccgtctgtgtccttggacgagtgttttcctgcgggtgttccagccgacttcgagccagcatttcaggaaaggccccaaagtcccggtgctgctgtcgccctgtgttcaccggacgcaaaagggttcgagggaacagcctcggaagaagctcaagagagtggccataaggccgtccacgctgtaccccttgccgaaggtcccaataatgaacaggtacaggtggttgctggtgagcagctagagctcggcggttgtggtttggcaatcgggagtgctcagtcctcttcagactccaagagagaaaacatgcacaatagccgggaagacgaaccattggatttgtcccacccagcaccggctgccacgacgacccttgtgggagagcaaacacccgacaacccaggttctgatgccagtgctctccccatcgccgttcgaggatttgtcccgacagggcccatactccgtcatgttgagcactgcggcacagagtcaggcgacagcagttcgcctttggatctgtcttttgcgcaaacgttggaccagcctttagatctatccttggccgcttggccggtgaaggccaccgcgtctgatcctggctgggtccgcggtaggtgcgagcctgtctttttaaagcctcggaaagctttctctgatggcgattcggcccttcagttcggggagctttctgagtccagctctgtcatcgagtttgaccagacaaaagatactctggtggctgacgcccctgttgacttgacgacttcgaacgaggccctctctgcagtcgacccttccgaatttgtcgaactcaggcgcccgcgtcattccgcacaagccttaattgaccgaggcggtccacttgctgatgtccatgcgaaaataaagaaccgggtgtatgaacagtgcctccaagcttgtgagcctggtagtcgtgcaaccccagccaccagggagtggctcgacaaaatgtgggatagggtggacatgaaaacttggcgctgcacttcacagttccaggccggtcgcattcttgcgtccctcaaatttcttcctgacatgattcaagacacgccgcctcctgtccccaagaagaaccgagctagtgacagtgccggtctgaagcaactggtggcacggtgggataagaaattgagtgtaaccccccccccaaaatcggctgggttagtgcttgaccagaccgtccctccgcctacggatatccagcaagaggatgccaccccctccgacgggttatcccatgcatcggatttttctagtcgagtgagcacgagctggagttggaaaggccttatgctttccggcacccgtctcgcggggtctgctggtcagcgcctcatgacatgggtattcgaagtttactcccatctcccagcttttatactcacacttttctcgccgcggggctctatggctccaggcgattggttgtttgcaggtgttgttttacttgctctcttgctctgtcgttcttacccaatactcggatgccttcccttactgggtgtcttctctggttctttgcggcgtgttcgtctgggtgtttttggttcttggatggcttttgctgtatttttattctcgactccatccaacccagtcggttcttcttgtgaccacgattcgccggaatgtcatgctgagcttttggctcttgagcagcgccaactttgggaacctgtgcgcggccttgtggttggcccctcaggtctcttatgtgtcatccttggcaagttactcggtgggtcacgtcatctctggcatgttatcctacgtttatgcatgcttacagatttggccctttctcttgtttatgtggtgtcccaagggcgttgtcacaagtgttggggaaagtgtataaggacagctcctgctgaggtggctctcaatgtatttcctttctcgcgcgccactcgcaactctctcacatccttgtgtgatcggttccaaactcctaaaggagttgatcccgtgcacttggcaacgggttggcgcgggtgttggcgtggtgagagtcccatccatcaaccacaccaaaagcccatagcttatgccaatttggatgaaaagaaaatatctgctcaaacggtggttgctgtcccatacgaccccagtcaggctatcaaatgtctgaaggttctgcaggcgggaggggctatcgtggaccagcctacgcctgaagttgttcgtgtgtctgaaatccccttttcagccccatttttcccaaaagttccagtcaacccagattgcaggattgtggtggattcagatacttttgtggctgcagtccgctgcggttactcgacagcacaactggtcctaggccggggcaactttgccaagttgaatcagaccccccttagggactctgcctccaccaaaacgactggtggggcctcttatactcttgctgtggctcaagtgtctgtgtggactcttgttcatttcatcctcggtctttggttcacatcacctcaagtgtgtggccgaggaaccgctgacccttggtgttcaaatcccttttcgtatcctgcctacggccctggagttgtgtgctcctctcgactttgtgtgtctgccgatggggtcaccctgccattgttctcagctgtggcacaactctccggtagagaggtagggatttttattttagtgcttgtttccttgactgccttggcccatcgcctggctcttaaggcagacatgttagtggtcttttcagctttttgtgcttacgcctggcccatgagctcctggttaatctgcttctttcctatactcttaaagtgggttacccttcaccccctcactatgctttgggtgcactcattcttggtgttttgtatgccagcagccggcatcctctcactagggataactggccttctctgggcagttggccgctttacccaggttgccggaattattacaccttatgacatccaccagtatacctctgggccacgcggtgcagccgctgtagccacagccccagaaggcacttatatggccgccgtccggagagctgctttaactggacgaactttgatcttcaccccgtctgcggtcggatcccttcttgaaggtgctttcaggactcataaaccctgccttaacaccgtgaatgttgtgggttcttcccttggttctggaggggtttttaccattgatggcagaaagaccgtcgtcactgctgctcatgtgttgaacggcgacacagctagagttaccggcgactcttacaaccgcatgcacacttttaagaccagtggcgattatgcctggtcccatgctgatgactggcagggcgttgcccctgtggtcaaggttgcgaaggggtatcgcggtcgtgcctactggcaaacatcaaccggtgtcgaacccggcgtcattggggaagggttcgccttctgtttcaccaactgtggcgattcggggtcacccgtcatctcagaatctggtgatctcatcggaatccataccggttcaaacaaactcggttctggtcttgtgacgacccctgaaggggaaacctgcgccatcaaagaaaccaagctctctgacctttccagacattttgcgggcccgagcgtccctcttggggacattaaattgagtccggccatcgtccctgatgtaacatctattccgagtgacttggcatcgctcctagcttccgtccctgtaatggaaggcggcctctcgaccgttcaacttctgtgtgtctttttccttctctggcgcatgatgggccatgcctggacacccattgttgccgtgggcttctttttgctgaatgaaattcttccagcagttttggtccgagccgtgttttcctttgcactctttattcttgcatgggccaccccctggtccgcacaggtgttaatgattagactcctcacggcatccctcaaccgcaacaagttgtctctggcgttctacgcacttgggggtgtcgtcggtttggccgctgaaatcggggcttttgccggcaggctgcctgaattgtctcaagctctttcgacatactgtttcttacctagggtccttgcgatggccagttatgttcccatcatcatcattggtggactccatgccctcggtgtgattctgtggttgttcaaataccggtgcctccacaacatgctggttggtgatgggagtttctcaagcgctttcttcctacggtattttgcagagggtaatcttagaaaaggtgtttcacagtcttgtggcatgagtaacgagtccctgacggctgctctagcttgcaagttgtcgcaggctgaccttgactttttgtccagcttaacgaacttcaagtgctttgtatctgcttcaaacatgaaaaatgctgccggccagtatattgaagcagcgtatgccaaggccctgcgccaagagttggcctccctagttcaggttgacaaaatgaaaggaattttgtctaagcttgaggcctttgctgaaacagccactccgtcccttgacgcaggtgacgtggttgttctgcttgggcaacatcctcacggatccatcctcgatattaatgtggggactgaaaggaaaactgtgtccgtgcaagagacccggagcttaggtggttccaaattcagtgtttgcactgtcgtgtccaacacacccgtggacgccttaactggcatcccactccagacaccaacccctctttttgagaatggtccgcgtcaccgtggtgaggaagacgatcttagagtcgagaggatgaagaaacactgtgtgtccctcggcttccacaacattaatggcaaagtttactgcaaaatttgggacaagtccaccggtgataccttttataccgatgattcccggtacacccaagaccttgcattccaggacaggtcagccgactacagagacagggattatgagggtgtgcaaaccgccccccaacagggctttgatccaaagtctgaaacccctattggcactgtggtgatcggcggtatcacgtataacaggtacctgatcaaaggtaaggaggtcttggttcccaagcctgacaactgccttgaagctgccaagctgtcccttgagcaagctctcgctgggatgggccaaacttgcgaccttacagctgccgaggtggaaaagttgaggcgcatcattagccagctccaaggtttgaccactgaacaggctttaaactgttaggcggccgcctcgagggatcctctactagagtcgaggcggctgctaacaaagccccaaaggaagctgagttggctgctgccaccgctgagcaataactagcataaccccttggggcctctaaacgggtcttgaggggttttttgctgaaaggaggaactatatccggatcgagatccccaattctgtgagcgtatggcaaacgaaggaaaaatagttatagtagccgcactcgatgggacatttcaacgtaaaccgtttaataattcgaggagcttttgttccctttagtgagggttaatttcgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattccgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagatccttgaagacaaacaacgtctgtagcgaccctttgcaggcagcggaaccccccacctggcgacaggtgcctctgcggccaaaagccacgtgtataagatacacctgcaaaggcggcacaac

SEQ ID NO: 18 - DNA, 11144 bp, Porcine reproductive and respiratory syndrome virus
cccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgataataccatggctgggacgttctcccggtgcatgtgcaccccggctgcccgggtattttggaacgccggccaagtcttttgcacacggtgtctcagtgcgcggcctcttctctctccggaacttcaggacactgacctcggtgtagttggattgttttacaagcctaaggacaagattcactggaaagttcctatcggcattcctcaggtggagtgtactccatccgggtgctgctggctctcagccgtattccctttggcgcgcatgacttccggtaatcacaacttcctccaacgacttgttaaggttgctgatgttttgtatcgcgatggttgcttggcgcctcgacacctccgtgaactccaagtttacgagcgcggttgtagctggtacccaattacggggcccgtacccggaatgggtttgtttgcgaactccatgcacgtgtctgaccagccgttccctggtgccacccatgtgttgactaactcgcctctgcctcagcgggcgtgccggcagccgttctgtccatttgaggaagctcattctgacgtttacaggtggaagaaatttgtgatttttacggactcctctcccaacggtcgatttcgcatgatgtggacgccggaatccgatgactcagccgccctggaggtgctgccgcccgagttagaacgtcaggtcgagatcctcactcggagttttcccgctcatcaccctatcaacctagctgactgggagctcactgagtcccctgagaacggtttttctttcggcacgtcccattcttgcggccacatcgtccagaaccccaacgtgtttgacggcaagtgctggctcacctgctttttgggccaatcggctgaagtgtgctaccacgaggaacatctagctaacgccctcggttaccaaaccaagtggggcgtgcatggtaagtacctccaacgcaggcttcaagtccgcggcatgcgtgctgtggtcgatcctgacggccctattcacgttgaagcgctgtcttgctcccagtcttgggtcaggcacctgactctgaataatgatgtcaccccaggattcgttcgcctgacatccatccgcattgtgtccaacacagaacccaccgctttccggatctttcggtttggagcacataagtggtatggcgctgccggcaaacgggctcgtgccaaacgtgccaccaaaagtgggaaggattcggccctcgctcccaagattgccccaccggtccccacctgtggaatcaccacctactctccaccgacagacgggtcttgtggttggcacgttcttgccgccatagtgaatcggatgataaacggtgactttacgtcccccctgcctcagtacaacagaccagaggatgattgggcttctgattatgatcttgctcaggcgattcaatgtttacaactgcctgccaccgtggttcggaatcgcgcctgtcctaacgccaagtacctcataaagctaaacggggttcactgggaagtagaggtgagatctggaatggctcctcgttccctttctcgtgaatgtgtagttggcgtttgctctgaaggctgtgtcgcaccgccttatccagcggacgggcttcctaaacgtgcactcgaggccttggcgtctgcctacagactaccctcagattgtgttagctctggtattgctgactttcttgctgatccacctcctcaggaattctggactctcgacaaaatgttgacctccccgtcaccggagcggtccggcttctccagcttgtataaattactcttagaggttgttccgcaaaaatgtggtgctacggaaggggctttcgtctatgctgttgagaggatgttaaaggactgtccgagccccgaacaggcgatggcccttctggcaaaaattaaagttccatcctcaaaggccccgtctgtgtccttggacgagtgttttcctgcgggtgttccagccgacttcgagccagcatttcaggaaaggccccaaagtcccggtgctgctgtcgccctgtgttcaccggacgcaaaagggttcgagggaacagcctcggaagaagctcaagagagtggccataaggccgtccacgctgtaccccttgccgaaggtcccaataatgaacaggtacaggtggttgctggtgagcagctagagctcggcggttgtggtttggcaatcgggagtgctcagtcctcttcagactccaagagagaaaacatgcacaatagccgggaagacgaaccattggatttgtcccacccagcaccggctgccacgacgacccttgtgggagagcaaacacccgacaacccaggttctgatgccagtgctctccccatcgccgttcgaggatttgtcccgacagggcccatactccgtcatgttgagcactgcggcacagagtcaggcgacagcagttcgcctttggatctgtcttttgcgcaaacgttggaccagcctttagatctatccttggccgcttggccggtgaaggccaccgcgtctgatcctggctgggtccgcggtaggtgcgagcctgtctttttaaagcctcggaaagctttctctgatggcgattcggcccttcagttcggggagctttctgagtccagctctgtcatcgagtttgaccagacaaaagatactctggtggctgacgcccctgttgacttgacgacttcgaacgaggccctctctgcagtcgacccttccgaatttgtcgaactcaggcgcccgcgtcattccgcacaagccttaattgaccgaggcggtccacttgctgatgtccatgcgaaaataaagaaccgggtgtatgaacagtgcctccaagcttgtgagcctggtagtcgtgcaaccccagccaccagggagtggctcgacaaaatgtgggatagggtggacatgaaaacttggcgctgcacttcacagttccaggccggtcgcattcttgcgtccctcaaatttcttcctgacatgattcaagacacgccgcctcctgtccccaagaagaaccgagctagtgacagtgccggtctgaagcaactggtggcacggtgggataagaaattgagtgtaaccccccccccaaaatcggctgggttagtgcttgaccagaccgtccctccgcctacggatatccagcaagaggatgccaccccctccgacgggttatcccatgcatcggatttttctagtcgagtgagcacgagctggagttggaaaggccttatgctttccggcacccgtctcgcggggtctgctggtcagcgcctcatgacatgggtttttgaagtttatagtcatttgccagcttttatactcacacttttctcgccgcggggctctatggctccaggcgattggttgtttgcaggtgttgttttacttgctctcttgctctgtcgttcttacccaatactcggatgccttcccttactgggtgtcttctctggttctttgcggcgtgttcgtctgggtgtttttggttcttggatggcttttgctgtatttttattctcgactccatccaacccagtcggttcttcttgtgaccacgattcgccggaatgtcatgctgagcttttggctcttgagcagcgccaactttgggaacctgtgcgcggccttgtggttggcccctcaggtctcttatgtgtcatccttggcaagttactcggtgggtcacgtcatctctggcatgttatcctacgtttatgcatgcttacagatttggccctttctcttgtttatgtggtgtcccaagggcgttgtcacaagtgttggggaaagtgtataaggacagctcctgctgaggtggctctcaatgtatttcctttctcgcgcgccactcgcaactctctcacatccttgtgtgatcggttccaaactcctaaaggagttgatcccgtgcacttggcaacgggttggcgcgggtgttggcgtggtgagagtcccatccatcaaccacaccaaaagcccatagcttatgccaatttggatgaaaagaaaatatctgctcaaacggtggttgctgtcccatacgaccccagtcaggctatcaaatgtctgaaggttctgcaggcgggaggggctatcgtggaccagcctacgcctgaagttgttcgtgtgtctgaaatccccttttcagccccatttttcccaaaagttccagtcaacccagattgcaggattgtggtggattcagatacttttgtggctgcagtccgctgcggttactcgacagcacaactggtcctaggccggggcaactttgccaagttgaatcagaccccccttagggactctgcctccaccaaaacgactggtggggcctcttatactcttgctgtggctcaagtgtctgtgtggactcttgttcatttcatcctcggtctttggttcacatcacctcaagtgtgtggccgaggaaccgctgacccttggtgttcaaatcccttttcgtatcctgcctacggccctggagttgtgtgctcctctcgactttgtgtgtctgccgatggggtcaccctgccattgttctcagctgtggcacaactctccggtagagaggtagggatttttattttagtgcttgtttccttgactgccttggcccatcgcctggctcttaaggcagacatgttagtggtcttttcagctttttgtgcttacgcctggcccatgagctcctggttaatctgcttctttcctatactcttaaagtgggttacccttcaccccctcactatgctttgggtgcactcattcttggtgttttgtatgccagcagccggcatcctctcactagggataactggccttctctgggcagttggccgctttacccaggttgccggaattattacaccttatgacatccaccagtatacctctgggccacgcggtgcagccgctgtagccacagccccagaaggcacttatatggccgccgtccggagagctgctttaactggacgaactttgatcttcaccccgtctgcggtcggatcccttcttgaaggtgctttcaggactcataaaccctgccttaacaccgtgaatgttgtgggttcttcccttggttctggaggggtttttaccattgatggcagaaagaccgtcgtcactgctgctcatgtgttgaacggcgacacagctagagttaccggcgactcttacaaccgcatgcacacttttaagaccagtggcgattatgcctggtcccatgctgatgactggcagggcgttgcccctgtggtcaaggttgcgaaggggtatcgcggtcgtgcctactggcaaacatcaaccggtgtcgaacccggcgtcattggggaagggttcgccttctgtttcaccaactgtggcgattcggggtcacccgtcatctcagaatctggtgatctcatcggaatccataccggttcaaacaaactcggttctggtcttgtgacgacccctgaaggggaaacctgcgccatcaaagaaaccaagctctctgacctttccagacattttgcgggcccgagcgtccctcttggggacattaaattgagtccggccatcgtccctgatgtaacatctattccgagtgacttggcatcgctcctagcttccgtccctgtaatggaaggcggcctctcgaccgttcaacttctgtgtgtctttttccttctctggcgcatgatgggccatgcctggacacccattgttgccgtgggcttctttttgctgaatgaaattcttccagcagttttggtccgagccgtgttttcctttgcactctttattcttgcatgggccaccccctggtccgcacaggtgttaatgattagactcctcacggcatccctcaaccgcaacaagttgtctctggcgttctacgcacttgggggtgtcgtcggtttggccgctgaaatcggggcttttgccggcaggctgcctgaattgtctcaagctctttcgacatactgtttcttacctagggtccttgcgatggccagttatgttcccatcatcatcattggtggactccatgccctcggtgtgattctgtggttgttcaaataccggtgcctccacaacatgctggttggtgatgggagtttctcaagcgctttcttcctacggtattttgcagagggtaatcttagaaaaggtgtttcacagtcttgtggcatgagtaacgagtccctgacggctgctctagcttgcaagttgtcgcaggctgaccttgactttttgtccagcttaacgaacttcaagtgctttgtatctgcttcaaacatgaaaaatgctgccggccagtatattgaagcagcgtatgccaaggccctgcgccaagagttggcctccctagttcaggttgacaaaatgaaaggaattttgtctaagcttgaggcctttgctgaaacagccactccgtcccttgacgcaggtgacgtggttgttctgcttgggcaacatcctcacggatccatcctcgatattaatgtggggactgaaaggaaaactgtgtccgtgcaagagacccggagcttaggtggttccaaattcagtgtttgcactgtcgtgtccaacacacccgtggacgccttaactggcatcccactccagacaccaacccctctttttgagaatggtccgcgtcaccgtggtgaggaagacgatcttagagtcgagaggatgaagaaacactgtgtgtccctcggcttccacaacattaatggcaaagtttactgcaaaatttgggacaagtccaccggtgataccttttataccgatgattcccggtacacccaagaccttgcattccaggacaggtcagccgactacagagacagggattatgagggtgtgcaaaccgccccccaacagggctttgatccaaagtctgaaacccctattggcactgtggtgatcggcggtatcacgtataacaggtacctgatcaaaggtaaggaggtcttggttcccaagcctgacaactgccttgaagctgccaagctgtcccttgagcaagctctcgctgggatgggccaaacttgcgaccttacagctgccgaggtggaaaagttgaggcgcatcattagccagctccaaggtttgaccactgaacaggctttaaactgttaggcggccgcctcgagggatcctctactagagtcgaggcggctgctaacaaagccccaaaggaagctgagttggctgctgccaccgctgagcaataactagcataaccccttggggcctctaaacgggtcttgaggggttttttgctgaaaggaggaactatatccggatcgagatccccaattctgtgagcgtatggcaaacgaaggaaaaatagttatagtagccgcactcgatgggacatttcaacgtaaaccgtttaataattcgaggagcttttgttccctttagtgagggttaatttcgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattccgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagatccttgaagacaaacaacgtctgtagcgaccctttgcaggcagcggaaccccccacctggcgacaggtgcctctgcggccaaaagccacgtgtataagatacacctgcaaaggcggcacaac

SEQ ID NO: 19 - DNA, 16 bp, Porcine reproductive and respiratory syndrome virus
tttatagtcatttgcc

SEQ ID NO: 20 - DNA, 11158 bp, Porcine reproductive and respiratory syndrome virus
cccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgataataccatggctgggacgttctcccggtgcatgtgcaccccggctgcccgggtattttggaacgccggccaagtcttttgcacacggtgtctcagtgcgcggcctcttctctctccggaacttcaggacactgacctcggtgtagttggattgttttacaagcctaaggacaagattcactggaaagttcctatcggcattcctcaggtggagtgtactccatccgggtgctgctggctctcagccgtattccctttggcgcgcatgacttccggtaatcacaacttcctccaacgacttgttaaggttgctgatgttttgtatcgcgatggttgcttggcgcctcgacacctccgtgaactccaagtttacgagcgcggttgtagctggtacccaattacggggcccgtacccggaatgggtttgtttgcgaactccatgcacgtgtctgaccagccgttccctggtgccacccatgtgttgactaactcgcctctgcctcagcgggcgtgccggcagccgttctgtccatttgaggaagctcattctgacgtttacaggtggaagaaatttgtgatttttacggactcctctcccaacggtcgatttcgcatgatgtggacgccggaatccgatgactcagccgccctggaggtgctgccgcccgagttagaacgtcaggtcgagatcctcactcggagttttcccgctcatcaccctatcaacctagctgactgggagctcactgagtcccctgagaacggtttttctttcggcacgtcccattcttgcggccacatcgtccagaaccccaacgtgtttgacggcaagtgctggctcacctgctttttgggccaatcggctgaagtgtgctaccacgaggaacatctagctaacgccctcggttaccaaaccaagtggggcgtgcatggtaagtacctccaacgcaggcttcaagtccgcggcatgcgtgctgtggtcgatcctgacggccctattcacgttgaagcgctgtcttgctcccagtcttgggtcaggcacctgactctgaataatgatgtcaccccaggattcgttcgcctgacatccatccgcattgtgtccaacacagaacccaccgctttccggatctttcggtttggagcacataagtggtatggcgctgccggcaaacgggctcgtgccaaacgtgccaccaaaagtgggaaggattcggccctcgctcccaagattgccccaccggtccccacctgtggaatcaccacctactctccaccgacagacgggtcttgtggttggcacgttcttgccgccatagtgaatcggatgataaacggtgactttacgtcccccctgcctcagtacaacagaccagaggatgattgggcttctgattatgatcttgctcaggcgattcaatgtttacaactgcctgccaccgtggttcggaatcgcgcctgtcctaacgccaagtacctcataaagctaaacggggttcactgggaagtagaggtgagatctggaatggctcctcgttccctttctcgtgaatgtgtagttggcgtttgctctgaaggctgtgtcgcaccgccttatccagcggacgggcttcctaaacgtgcactcgaggccttggcgtctgcctacagactaccctcagattgtgttagctctggtattgctgactttcttgctgatccacctcctcaggaattctggactctcgacaaaatgttgacctccccgtcaccggagcggtccggcttctccagcttgtataaattactcttagaggttgttccgcaaaaatgtggtgctacggaaggggctttcgtctatgctgttgagaggatgttaaaggactgtccgagccccgaacaggcgatggcccttctggcaaaaattaaagttccatcctcaaaggccccgtctgtgtccttggacgagtgttttcctgcgggtgttccagccgacttcgagccagcatttcaggaaaggccccaaagtcccggtgctgctgtcgccctgtgttcaccggacgcaaaagggttcgagggaacagcctcggaagaagctcaagagagtggccataaggccgtccacgctgtaccccttgccgaaggtcccaataatgaacaggtacaggtggttgctggtgagcagctagagctcggcggttgtggtttggcaatcgggagtgctcagtcctcttcagactccaagagagaaaacatgcacaatagccgggaagacgaaccattggatttgtcccacccagcaccggctgccacgacgacccttgtgggagagcaaacacccgacaacccaggttctgatgccagtgctctccccatcgccgttcgaggatttgtcccgacagggcccatactccgtcatgttgagcactgcggcacagagtcaggcgacagcagttcgcctttggatctgtcttttgcgcaaacgttggaccagcctttagatctatccttggccgcttggccggtgaaggccaccgcgtctgatcctggctgggtccgcggtaggtgcgagcctgtctttttaaagcctcggaaagctttctctgatggcgattcggcccttcagttcggggagctttctgagtccagctctgtcatcgagtttgaccagacaaaagatactctggtggctgacgcccctgttgacttgacgacttcgaacgaggccctctctgcagtcgacccttccgaatttgtcgaactcaggcgcccgcgtcattccgcacaagccttaattgaccgaggcggtccacttgctgatgtccatgcgaaaataaagaaccgggtgtatgaacagtgcctccaagcttgtgagcctggtagtcgtgcaaccccagccaccagggagtggctcgacaaaatgtgggatagggtggacatgaaaacttggcgctgcacttcacagttccaggccggtcgcattcttgcgtccctcaaatttcttcctgacatgattcaagacacgccgcctcctgtccccaagaagaaccgagctagtgacagtgccggtctgaagcaactggtggcacggtgggataagaaattgagtgtaaccccccccccaaaatcggctgggttagtgcttgaccagaccgtccctccgcctacggatatccagcaagaggatgccaccccctccgacgggttatcccatgcatcggatttttctagtcgagtgagcacgagctggagttggaaaggccttatgctttccggcacccgtctcgcggggtctgctggtcagcgcctcatgacatgggtttttgaagtttacagaaatatggcagcttttatactcacacttttatactcacacttttctcgccgcggggctctatggctccaggcgattggttgtttgcaggtgttgttttacttgctctcttgctctgtcgttcttacccaatactcggatgccttcccttactgggtgtcttctctggttctttgcggcgtgttcgtctgggtgtttttggttcttggatggcttttgctgtatttttattctcgactccatccaacccagtcggttcttcttgtgaccacgattcgccggaatgtcatgctgagcttttggctcttgagcagcgccaactttgggaacctgtgcgcggccttgtggttggcccctcaggtctcttatgtgtcatccttggcaagttactcggtgggtcacgtcatctctggcatgttatcctacgtttatgcatgcttacagatttggccctttctcttgtttatgtggtgtcccaagggcgttgtcacaagtgttggggaaagtgtataaggacagctcctgctgaggtggctctcaatgtatttcctttctcgcgcgccactcgcaactctctcacatccttgtgtgatcggttccaaactcctaaaggagttgatcccgtgcacttggcaacgggttggcgcgggtgttggcgtggtgagagtcccatccatcaaccacaccaaaagcccatagcttatgccaatttggatgaaaagaaaatatctgctcaaacggtggttgctgtcccatacgaccccagtcaggctatcaaatgtctgaaggttctgcaggcgggaggggctatcgtggaccagcctacgcctgaagttgttcgtgtgtctgaaatccccttttcagccccatttttcccaaaagttccagtcaacccagattgcaggattgtggtggattcagatacttttgtggctgcagtccgctgcggttactcgacagcacaactggtcctaggccggggcaactttgccaagttgaatcagaccccccttagggactctgcctccaccaaaacgactggtggggcctcttatactcttgctgtggctcaagtgtctgtgtggactcttgttcatttcatcctcggtctttggttcacatcacctcaagtgtgtggccgaggaaccgctgacccttggtgttcaaatcccttttcgtatcctgcctacggccctggagttgtgtgctcctctcgactttgtgtgtctgccgatggggtcaccctgccattgttctcagctgtggcacaactctccggtagagaggtagggatttttattttagtgcttgtttccttgactgccttggcccatcgcctggctcttaaggcagacatgttagtggtcttttcagctttttgtgcttacgcctggcccatgagctcctggttaatctgcttctttcctatactcttaaagtgggttacccttcaccccctcactatgctttgggtgcactcattcttggtgttttgtatgccagcagccggcatcctctcactagggataactggccttctctgggcagttggccgctttacccaggttgccggaattattacaccttatgacatccaccagtatacctctgggccacgcggtgcagccgctgtagccacagccccagaaggcacttatatggccgccgtccggagagctgctttaactggacgaactttgatcttcaccccgtctgcggtcggatcccttcttgaaggtgctttcaggactcataaaccctgccttaacaccgtgaatgttgtgggttcttcccttggttctggaggggtttttaccattgatggcagaaagaccgtcgtcactgctgctcatgtgttgaacggcgacacagctagagttaccggcgactcttacaaccgcatgcacacttttaagaccagtggcgattatgcctggtcccatgctgatgactggcagggcgttgcccctgtggtcaaggttgcgaaggggtatcgcggtcgtgcctactggcaaacatcaaccggtgtcgaacccggcgtcattggggaagggttcgccttctgtttcaccaactgtggcgattcggggtcacccgtcatctcagaatctggtgatctcatcggaatccataccggttcaaacaaactcggttctggtcttgtgacgacccctgaaggggaaacctgcgccatcaaagaaaccaagctctctgacctttccagacattttgcgggcccgagcgtccctcttggggacattaaattgagtccggccatcgtccctgatgtaacatctattccgagtgacttggcatcgctcctagcttccgtccctgtaatggaaggcggcctctcgaccgttcaacttctgtgtgtctttttccttctctggcgcatgatgggccatgcctggacacccattgttgccgtgggcttctttttgctgaatgaaattcttccagcagttttggtccgagccgtgttttcctttgcactctttattcttgcatgggccaccccctggtccgcacaggtgttaatgattagactcctcacggcatccctcaaccgcaacaagttgtctctggcgttctacgcacttgggggtgtcgtcggtttggccgctgaaatcggggcttttgccggcaggctgcctgaattgtctcaagctctttcgacatactgtttcttacctagggtccttgcgatggccagttatgttcccatcatcatcattggtggactccatgccctcggtgtgattctgtggttgttcaaataccggtgcctccacaacatgctggttggtgatgggagtttctcaagcgctttcttcctacggtattttgcagagggtaatcttagaaaaggtgtttcacagtcttgtggcatgagtaacgagtccctgacggctgctctagcttgcaagttgtcgcaggctgaccttgactttttgtccagcttaacgaacttcaagtgctttgtatctgcttcaaacatgaaaaatgctgccggccagtatattgaagcagcgtatgccaaggccctgcgccaagagttggcctccctagttcaggttgacaaaatgaaaggaattttgtctaagcttgaggcctttgctgaaacagccactccgtcccttgacgcaggtgacgtggttgttctgcttgggcaacatcctcacggatccatcctcgatattaatgtggggactgaaaggaaaactgtgtccgtgcaagagacccggagcttaggtggttccaaattcagtgtttgcactgtcgtgtccaacacacccgtggacgccttaactggcatcccactccagacaccaacccctctttttgagaatggtccgcgtcaccgtggtgaggaagacgatcttagagtcgagaggatgaagaaacactgtgtgtccctcggcttccacaacattaatggcaaagtttactgcaaaatttgggacaagtccaccggtgataccttttataccgatgattcccggtacacccaagaccttgcattccaggacaggtcagccgactacagagacagggattatgagggtgtgcaaaccgccccccaacagggctttgatccaaagtctgaaacccctattggcactgtggtgatcggcggtatcacgtataacaggtacctgatcaaaggtaaggaggtcttggttcccaagcctgacaactgccttgaagctgccaagctgtcccttgagcaagctctcgctgggatgggccaaacttgcgaccttacagctgccgaggtggaaaagttgaggcgcatcattagccagctccaaggtttgaccactgaacaggctttaaactgttaggcggccgcctcgagggatcctctactagagtcgaggcggctgctaacaaagccccaaaggaagctgagttggctgctgccaccgctgagcaataactagcataaccccttggggcctctaaacgggtcttgaggggttttttgctgaaaggaggaactatatccggatcgagatccccaattctgtgagcgtatggcaaacgaaggaaaaatagttatagtagccgcactcgatgggacatttcaacgtaaaccgtttaataattcgaggagcttttgttccctttagtgagggttaatttcgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattccgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagatccttgaagacaaacaacgtctgtagcgaccctttgcaggcagcggaaccccccacctggcgacaggtgcctctgcggccaaaagccacgtgtataagatacacctgcaaaggcggcacaac

SEQ ID NO: 21 - DNA, 24 bp, Porcine reproductive and respiratory syndrome virus
gtttacagaaatatggcagctttt

SEQ ID NO: 22 - DNA, 18038 bp, Porcine reproductive and respiratory syndrome virus
gcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccttaataagatgatcttcttgagatcgttttggtctgcgcgtaatctcttgctctgaaaacgaaaaaaccgccttgcagggcggtttttcgaaggttctctgagctaccaactctttgaaccgaggtaactggcttggaggagcgcagtcaccaaaacttgtcctttcagtttagccttaaccggcgcatgacttcaagactaactcctctaaatcaattaccagtggctgctgccagtggtgcttttgcatgtctttccgggttggactcaagacgatagttaccggataaggcgcagcggtcggactgaacggggggttcgtgcatacagtccagcttggagcgaactgcctacccggaactgagtgtcaggcgtggaatgagacaaacgcggccataacagcggaatgacaccggtaaaccgaaaggcaggaacaggagagcgcacgagggagccgccagggggaaacgcctggtatctttatagtcctgtcgggtttcgccaccactgatttgagcgtcagatttcgtgatgcttgtcaggggggcggagcctatggaaaaacggctttgccgcggccctctcacttccctgttaagtatcttcctggcatcttccaggaaatctccgccccgttcgtaagccatttccgctcgccgcagtcgaacgaccgagcgtagcgagtcagtgagcgaggaagcggaatatatcctgtatcacatattctgctgacgcaccggtgcagccttttttctcctgccacatgaagcacttcactgacaccctcatcagtgccaacatagtaagccagtatacactccgctagcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcagcgctcaaagatgcaggggtaaaagctaaccgcatctttaccgacaaggcatccggcagttcaacagatcgggaagggctggatttgctgaggatgaaggtggaggaaggtgatgtcattctggtgaagaagctcgaccgtcttggccgcgacaccgccgacatgatccaactgataaaagagtttgatgctcagggtgtagcggttcggtttattgacgacgggatcagtaccgacggtgatatggggcaaatggtggtcaccatcctgtcggctgtggcacaggctgaacgccggaggatccatattggcgcgcctaatacgactcactataggatgatgtgtagggtatcccccctacatacacaacactttttgtgtttgtgtactttggaggcgtgggtacagccccgccccaccccttggcccctgttctagcccaacaggtatccttctccctcggggcgagtgcgccgcctgctgctcccttgcagtgggaaggacctcccgagtatttccggagagcacctgctttacgggatctccaccctttaaccatgtctgggacgttctcccggtgcatgtgcaccccggctgcccgggtattttggaacgccggccaagtcttttgcacacggtgtctcagtgcgcggcctcttctctctccggaacttcaggacactgacctcggtgtagttggattgttttacaagcctaaggacaagattcactggaaagttcctatcggcattcctcaggtggagtgtactccatccgggtgctgctggctctcagccgtattccctttggcgcgcatgacttccggtaatcacaacttcctccaacgacttgttaaggttgctgatgttttgtatcgcgatggttgcttggcgcctcgacacctccgtgaactccaagtttacgagcgcggttgtagctggtacccaattacggggcccgtacccggaatgggtttgtttgcgaactccatgcacgtgtctgaccagccgttccctggtgccacccatgtgttgactaactcgcctctgcctcagcgggcgtgccggcagccgttctgtccatttgaggaagctcattctgacgtttacaggtggaagaaatttgtgatttttacggactcctctcccaacggtcgatttcgcatgatgtggacgccggaatccgatgactcagccgccctggaggtgctgccgcccgagttagaacgtcaggtcgagatcctcactcggagttttcccgctcatcaccctatcaacctagctgactgggagctcactgagtcccctgagaacggtttttctttcggcacgtcccattcttgcggccacatcgtccagaaccccaacgtgtttgacggcaagtgctggctcacctgctttttgggccaatcggctgaagtgtgctaccacgaggaacatctagctaacgccctcggttaccaaaccaagtggggcgtgcatggtaagtacctccaacgcaggcttcaagtccgcggcatgcgtgctgtggtcgatcctgacggccctattcacgttgaagcgctgtcttgctcccagtcttgggtcaggcacctgactctgaataatgatgtcaccccaggattcgttcgcctgacatccatccgcattgtgtccaacacagaacccaccgctttccggatctttcggtttggagcacataagtggtatggcgctgccggcaaacgggctcgtgccaaacgtgccaccaaaagtgggaaggattcggccctcgctcccaagattgccccaccggtccccacctgtggaatcaccacctactctccaccgacagacgggtcttgtggttggcacgttcttgccgccatagtgaatcggatgataaacggtgactttacgtcccccctgcctcagtacaacagaccagaggatgattgggcttctgattatgatcttgctcaggcgattcaatgtttacaactgcctgccaccgtggttcggaatcgcgcctgtcctaacgccaagtacctcataaagctaaacggggttcactgggaagtagaggtgagatctggaatggctcctcgttccctttctcgtgaatgtgtagttggcgtttgctctgaaggctgtgtcgcaccgccttatccagcggacgggcttcctaaacgtgcactcgaggccttggcgtctgcctacagactaccctcagattgtgttagctctggtattgctgactttcttgctgatccacctcctcaggaattctggactctcgacaaaatgttgacctccccgtcaccggagcggtccggcttctccagcttgtataaattactcttagaggttgttccgcaaaaatgtggtgctacggaaggggctttcgtctatgctgttgagaggatgttaaaggactgtccgagccccgaacaggccatggcccttctggcaaaaattaaagttccatcctcaaaggccccgtctgtgtccttggacgagtgttttcctgcgggtgttccagccgacttcgagccagcatttcaggaaaggccccaaagtcccggtgctgctgtcgccctgtgttcaccggacgcaaaagggttcgagggaacagcctcggaagaagctcaagagagtggccataaggccgtccacgctgtaccccttgccgaaggtcccaataatgaacaggtacaggtggttgctggtgagcagctagagctcggcggttgtggtttggcaatcgggagtgctcagtcctcttcagactccaagagagaaaacatgcacaatagccgggaagacgaaccattggatttgtcccacccagcaccggctgccacgacgacccttgtgggagagcaaacacccgacaacccaggttctgatgccagtgctctccccatcgccgttcgaggatttgtcccgacagggcccatactccgtcatgttgagcactgcggcacagagtcaggcgacagcagttcgcctttggatctgtcttttgcgcaaacgttggaccagcctttagatctatccttggccgcttggccggtgaaggccaccgcgtctgatcctggctgggtccgcggtaggtgcgagcctgtctttttaaagcctcggaaagctttctctgatggcgattcggcccttcagttcggggagctttctgagtccagctctgtcatcgagtttgaccagacaaaagatactctggtggctgacgcccctgttgacttgacgacttcgaacgaggccctctctgcagtcgacccttccgaatttgtcgaactcaggcgcccgcgtcattccgcacaagccttaattgaccgaggcggtccacttgctgatgtccatgcgaaaataaagaaccgggtgtatgaacagtgcctccaagcttgtgagcctggtagtcgtgcaaccccagccaccagggagtggctcgacaaaatgtgggatagggtggacatgaaaacttggcgctgcacttcacagttccaggccggtcgcattcttgcgtccctcaaatttcttcctgacatgattcaagacacgccgcctcctgtccccaagaagaaccgagctagtgacagtgccggtctgaagcaactggtggcacggtgggataagaaattgagtgtaaccccccccccaaaatcggctgggttagtgcttgaccagaccgtccctccgcctacggatatccagcaagaggatgccaccccctccgacgggttatcccatgcatcggatttttctagtcgagtgagcacgagctggagttggaaaggccttatgctttccggcacccgtctcgcggggtctgctggtcagcgcctcatgacatgggtgttcttgaagtttactcccatctcccagcttttatactcacacttttctcgccgcggggctctatggctccaggcgattggttgtttgcaggtgttgttttacttgctctcttgctctgtcgttcttacccaatactcggatgccttcccttactgggtgtcttctctggttctttgcggcgtgttcgtctgggtgtttttggttcttggatggcttttgctgtatttttattctcgactccatccaacccagtcggttcttcttgtgaccacgattcgccggaatgtcatgctgagcttttggctcttgagcagcgccaactttgggaacctgtgcgcggccttgtggttggcccctcaggtctcttatgtgtcatccttggcaagttactcggtgggtcacgtcatctctggcatgttatcctacgtttatgcatgcttacagatttggccctttctcttgtttatgtggtgtcccaagggcgttgtcacaagtgttggggaaagtgtataaggacagctcctgctgaggtggctctcaatgtatttcctttctcgcgcgccactcgcaactctctcacatccttgtgtgatcggttccaaactcctaaaggagttgatcccgtgcacttggcaacgggttggcgcgggtgttggcgtggtgagagtcccatccatcaaccacaccaaaagcccatagcttatgccaatttggatgaaaagaaaatatctgctcaaacggtggttgctgtcccatacgaccccagtcaggctatcaaatgtctgaaggttctgcaggcgggaggggctatcgtggaccagcctacgcctgaagttgttcgtgtgtctgaaatccccttttcagccccatttttcccaaaagttccagtcaacccagattgcaggattgtggtggattcagatacttttgtggctgcagtccgctgcggttactcgacagcacaactggtcctaggccggggcaactttgccaagttgaatcagaccccccttagggactctgcctccaccaaaacgactggtggggcctcttatactcttgctgtggctcaagtgtctgtgtggactcttgttcatttcatcctcggtctttggttcacatcacctcaagtgtgtggccgaggaaccgctgacccatggtgttcaaatcccttttcgtatcctgcctacggccctggagttgtgtgctcctctcgactttgtgtgtctgccgatggggtcaccctgccattgttctcagctgtggcacaactctccggtagagaggtagggatttttattttagtgcttgtttccttgactgccttggcccatcgcctggctcttaaggcagacatgttagtggtcttttcagctttttgtgcttacgcctggcccatgagctcctggttaatctgcttctttcctatactcttaaagtgggttacccttcaccccctcactatgctttgggtgcactcattcttggtgttttgtatgccagcagccggcatcctctcactagggataactggccttctctgggcagttggccgctttacccaggttgccggaattattacaccttatgacatccaccagtatacctctgggccacgcggtgcagccgctgtagccacagccccagaaggcacttatatggccgccgtccggagagctgctttaactggacgaactttgatcttcaccccgtctgcggtcggatcccttcttgaaggtgctttcaggactcataaaccctgccttaacaccgtgaatgttgtgggttcttcccttggttctggaggggtttttaccattgatggcagaaagaccgtcgtcactgctgctcatgtgttgaacggcgacacagctagagttaccggcgactcttacaaccgcatgcacacttttaagaccagtggcgattatgcctggtcccatgctgatgactggcagggcgttgcccctgtggtcaaggttgcgaaggggtatcgcggtcgtgcctactggcaaacatcaaccggtgtcgaacccggcgtcattggggaagggttcgccttctgtttcaccaactgtggcgattcggggtcacccgtcatctcagaatctggtgatctcatcggaatccataccggttcaaacaaactcggttctggtcttgtgacgacccctgaaggggaaacctgcgccatcaaagaaaccaagctctctgacctttccagacattttgcgggcccgagcgtccctcttggggacattaaattgagtccggccatcgtccctgatgtaacatctattccgagtgacttggcatcgctcctagcttccgtccctgtaatggaaggcggcctctcgaccgttcaacttctgtgtgtctttttccttctctggcgcatgatgggccatgcctggacacccattgttgccgtgggcttctttttgctgaatgaaattcttccagcagttttggtccgagccgtgttttcctttgcactctttattcttgcatgggccaccccctggtccgcacaggtgttaatgattagactcctcacggcatccctcaaccgcaacaagttgtctctggcgttctacgcacttgggggtgtcgtcggtttggccgctgaaatcggggcttttgccggcaggctgcctgaattgtctcaagctctttcgacatactgtttcttacctagggtccttgccatggccagttatgttcccatcatcatcattggtggactccatgccctcggtgtgattctgtggttgttcaaataccggtgcctccacaacatgctggttggtgatgggagtttctcaagcgctttcttcctacggtattttgcagagggtaatcttagaaaaggtgtttcacagtcttgtggcatgagtaacgagtccctgacggctgctctagcttgcaagttgtcgcaggctgaccttgactttttgtccagcttaacgaacttcaagtgctttgtatctgcttcaaacatgaaaaatgctgccggccagtatattgaagcagcgtatgccaaggccctgcgccaagagttggcctccctagttcaggttgacaaaatgaaaggaattttgtctaagcttgaggcctttgctgaaacagccactccgtcccttgacgcaggtgacgtggttgttctgcttgggcaacatcctcacggatccatcctcgatattaatgtggggactgaaaggaaaactgtgtccgtgcaagagacccggagcttaggtggttccaaattcagtgtttgcactgtcgtgtccaacacacccgtggacgccttaactggcatcccactccagacaccaacccctctttttgagaatggtccgcgtcaccgtggtgaggaagacgatcttagagtcgagaggatgaagaaacactgtgtgtccctcggcttccacaacattaatggcaaagtttactgcaaaatttgggacaagtccaccggtgataccttttataccgatgattcccggtacacccaagaccttgcattccaggacaggtcagccgactacagagacagggattatgagggtgtgcaaaccgccccccaacagggctttgatccaaagtctgaaacccctattggcactgtggtgatcggcggtatcacgtataacaggtacctgatcaaaggtaaggaggtcttggttcccaagcctgacaactgccttgaagctgccaagctgtcccttgagcaagctctcgctgggatgggccaaacttgcgaccttacagctgccgaggtggaaaagttgaggcgcatcattagccagctccaaggtttgaccactgaacaggctttaaactgttagccgccagcggcttgacccgctgtggccgcggcggcttagttgtaactgaaacagcggtaaaaatcgtaaagtaccacagcagaactttcaccctaggccctctggacctgaaagtcacctccgaggctgaggtaaagaaatcaactgagcagggccacgctgttgtggcaaacttatgttctggtgtcatcttgatgagacctcacccaccgtcccttgttgatgttcttctgaaacccggacttgacacaaaacccggcattcaaccagggcatggggccgggaatatgggcgtagacggctctacttgggattttgaaaccgcacccacaaaggcagaacttgagttgtccaaacaaataattcaagcatgtgaagttaggcgcggggacgccccgaacctccaactcccttacaagctctatcctgttagaggggatcctgagcggcatgggggccgccttatcaataccaggtttggagatctatcttacaaaacccctcaagacaccaagtccgcaatccatgcggcttgttgcctgcaccccaacggggcccctgtgtctgatggtaagtcaacactaggtaccacccttcaacatggtttcgaactttatgtccccactgtgccctatagtgtcatggagtacctcgattcacgccctgacacccctttcatgtgcactaaacatggtacttccaaggctgctgcagaagacctccaaaaatacgacctatctactcaaggatttgtcctgcccggggtcttacgccttgtacgcagattcatctttggccatattggtaaggcaccgccattgttcctcccgtcaacctatcccgctaaaaattctatggcagggatcaatggccagaggttcccaacaaaggacgtccagagcatacctgaaattgacgaaatgtgtgcccgcgccgtcaaggagaattggcaaactgtgacaccttgtaccctcaagaaacagtactgttccaagcccaaaaccaggaccatcctgggcaccaacaactttattgccctggctcaccgatcggcgctcagtggtgtcacccaggcattcatgaagaaggcttggaagtccccgattgccttgggaaaaaacaaattcaaggagctgcattgcactgtcgccggcaggtgtcttgaagccgacttggcctcctgtgaccgcagcacccccgccattgtgaggtggttcgtcgccaacctcctgtatgaacttgcaggatgtgaagagtacttgcctagctatgtgcttaactgctgccatgaccttgtggcaacacaggatggtgccttcacaaaacgcggtggcctgtcgtccggggaccccgtcaccagtgtgtctaacaccgtatattcactgataatctatgcccagcacatggtgttgtcggccttaaaaatgggtcatgaaatcggtctcaagttcctcgaggaacagctcaaattcgaggacctcctcgaaatccagcctatgttggtctattctgatgaccttgtcttgtacgctgaaaggcccacttttcctaattatcactggtgggtcgagcaccttgacctaatgctgggtttcagaacggacccaaagaagacagtcataactgataaacccagcttcctcggctgcagaattgaggcggggcgacagctggtccctaatcgcgaccgcatcctggctgctctcgcatatcacatgaaggcgcagaacgcctcagagtattatgcgtctgctgccgcaatcctgatggattcatgtgcttgcattgatcatgaccctgagtggtatgaggacctcatctgcggtatcgcccgatgcgcccgccaggatggttatagtttcccaggcccggcatttttcatgtccatgtgggaaaagctgagaagtcacaatgaagggaagaaatttcgacactgcggcatctgcgacgccaaagccgaccatgcatccgcctgtgggcttgatttgtgtttgttccactcacactttcatcaacactgccccgtcactctgagctgtggtcatcatgccggttcaagggaatgttcgcagtgtcagtcacctgttggggctggcagatctcctcttgatgccgtgctaaaacaaatcctgtacaaacctcctcgtacagtcatcatgaaggtgggtaacaaaacaacggccctcgatccggggaggtaccagtcccgtcgaggtcttgttgcagtcaagaggggtattgcaggcaatgaagttgatcttcctgatggggactaccaagtagtgcctcttttaccaacttgtaaagacataaacatggtaaaggtggcttgcaatgtactactcagtaagttcatagtggggccaccaggttccggaaagaccacctggttactgagtcaagtccaggacgatgatgtcatttacacacccacccatcagaccatgtttgatatagtcagtgctctcaaagtttgcaggtattctattccaggagcctcaggacttcctttcccaccacctgccaggtccgggccgtgggttaggctcgtggccagcgggcacgtccccggccgaacatcatacctcgatgaggctggatattgtaatcatctggacattctcagactgctttccaaaacacccctcgtgtgtttgggtgaccttcaacaacttcaccctgtcggctttgactcctactgttatgtgtttgatcagatgcctcaaaagcaactgaccactatttatagatttggccctaacatctgcgcagccatccagccttgttacagggagaagcttgaatctaaggctaggaacaccagggtggtctttaccacctggcctgtggcctttggtcaggtgctgacaccataccataaagatcgcatcggctctgcgataaccatagactcatcccagggggccactttcgacattgtgacattgcatctaccatcaccaaagtccctaaataaatcccgagcacttgtagccatcactcgggcaagacacgggttgttcatttatgaccctcacaaccagctccaggagtttttcaacctgatccctgagcgcactgattgcaaccttgtgttcagccgtggggatgatctggtagttcttagtgcggacaatgcagtcacaactgtagcgaaggccctagggacaggtccatctcgatttcgagtatcagacccgaggtgcaagtctctcttagctgcttgttcggccagtctggaggggagctgtatgccactaccacaagtggcacataacctggggttttacttctccccagacagtccagcatttgcacctctgccaaaggagttagcgccacattggccagtggttactcaccagaacaatcgggcgtggcccgatcgacttgtcgctagtatgcgcccaattgatgcccgctacagcaagccaatggtcggtgcagggtatgtggtcgggccgtccacctttcttggtactcctggtgtagtgtcatactacctcacgctatacatcaggggtgagccccaggccttgccagagacactcgtttcaacaggacgcatagccactgactgccgggagtatctcgacgcggctgaggaagaggcagcaaaagaactcccccacgcattcattggcgatgtcaaaggtaccacggtcggggggtgtcaccacatcacatcaaaatacctacccaggaccctgcctaaggactctgttgctgtagttggagtaagctcgcccggcagggctgctaaagccatgtgcactctcactgatgtgtatctccccgaactccggccatacctgcaacctgagacggcgtcgaaatgctggaaactcaaattagacttcagggacgtccgactaatggtctggaaaggagccaccgcccatttccagttggaaggacttacatggtcagcgctgcctgactatgccaggtttattcagcttcccaaggacgccgttgtgtacattgatccgtgtataggaccggcaacagccaaccgcaaggtcgtgcgaaccacagactggcgggccgacctggcagtgacaccgtatgattacggtgcccagaacattttgacaacagcctggttcgaggacctcgggccgcagtggaagattttggggttgcagcccttcaggcgggcatttggctttgaaaatactgaggattgggcaatccttgcacgccgtatgagtgacggcaaagactacactgactacaactgggattgtgttcgagaacgcccacacgccatctacgggcgtgctcgtgaccatacatatcattttgcccccggcacggaattgcaggtagagctgggtaaaccccggctgccgcctggacgagagccgtaaacttggagtgatgcaatggggtcactgtggagtaaaatcagccagctgttcgtggatgccttcactgagtttcttgtcagtgtggttgatattgtcattttccttgccatactgtttgggttcaccgtcgcaggatggttattggtctttcttctcagagtggtttgctccgcgcttctccgttcgcgctctgccattcactctcccgaactatcgaaggtcctatgaaagcttgttgcccaactgcaggccggatgtcccacaatttgcatttaagcacccattgggtatactttggcacatgcgagtttcccacctgattgatgagatggtctctcgccgcatttaccagaccatggaacattcaggtcaagcggcctggaaatatgtggtcggtgaggccactctcacgaagctatcaaagcttgatatagttactcatttccaacatctggccgcagtagaggcggattcttgccgctttctcagctcacgactcgtgatgctaaaaaatcttgccgttggcaatgtgagcctacagtacaacaccacgttggatcgcgttgaactcattttccccacgccaggtacgaggcccaagttgaccgacttcagacaatggctcatcagtgtgcatgcttccattttttcctctgtggcttcatctgttaccttgttcatagtgctttggctgcgaattccagctctacgctatgtttttggtttccattggcccacggcaacacatcattcgagctgaccatcaattataccatatgcatgccctgtcttaccagtcaagcagctcgccaaaggctcgagcccggtcgtaacatgtggtgcagaatagggcatgataggtgtgaggagcgtgaccatgatgagttgttaatgtccatcccgtccgggtacgacaacctcaaacttgagggatattatgcttggctggcttttttgtccttttcctacgcggcccaattccatccggagctgttcgggatagggaatgtgtcgcgcgtcttcgtggacaagcgacaccagtttatttgtgccgagcatggtggactcaattcaaccttatctaccgagcacaatatctccgcattatatgcggtatattatcaccaccaaatagacgggggtaattggttccatttggaatggctgcggccgcttttttcctcctggttggtgctcaacatatcatggtttctgaggcgttcgcctgtaagccctgtttctcgacgcatctatcagatattaagaccaacacgaccgcggctgccggtttcatggtccttcagaacatcaattgttcccggcctcacgaggcctcagcaacgcaaggtcaagttccctccagaaagtcgtcccaatgccgtgaagccgtcggtgttccccaatacatcacgataacggccaacgtgaccgacgaatcatatttgtacaacgcggacttgctgatgctttctgcgtgccttttctacgcctcggaaatgagcgagaaaggctttaaagttatctttgggaatgtctctggcgttgtttctgcttgtgtcaatttcacagattatgtggcccatgtgacccaacatacccagcagcatcatctggtgattaatcacatccggttactgcacttcctgacaccatctgcaatgaggtgggctacaaccattgcttgtctgttcgccattctcttggcgatatgaaatgttctcacaaattggggcattccttgactccgcactcttgcttctggtggctttttttgctgtgtaccggcttgtcctggtcctttgccgatggcaacggcaacaactcgacataccaatacatatataatttgacgatatgcgagttgaatgggaccaattggctgtccggccattttgaatgggcagttgagacctttgtgctttacccggttgtcactcatatcctctcactgggttttctcacgacaagtcatttttttgacgcgctcggtctcggcgctgtatccactgcaggatttgtcggagggcggtatgtacttagcagcgtctacggcgcttgtgctttcgcagcgttcgtatgcttcgtcatccgtgctgctaaaaattgcatggcctgccgctatgcccgtacccggttcaccaacttcattgtggacgaccgggggggagttcatagatggaagtctccaatagtggtagaaaaactgggcaaagccgaaattggcggcaaccttgtcaccatcaaacatgtcgtcctcgaaggggttaaagctcaacccttgacgagaacttcggccgagcaatgggaggcctagataatttttgcaacgatcctaccgccgcacaaaagatcgtgctagccttcagcatcacatacacacctataatgatatacgcccttaaggtgtcacgcggccgactcctggggctgttgcacatcctaatatttctgaactgttcctttacattcggatacatgacatatgtgcattttcattctacccaccgtgtcgcacttaccctgggggctgttgtcgcccttttgtggggtgtctacagcctcacagagtcatggaagtttatcacttccagatgcagattgtgttgcctcggccggcgatacattctggcccctgcccatcacgtagaaagtgctgcaggtctccattcaatctcagcgtctggtaaccgagcatacgctgtgagaaagcccggactaacatcagtgaacggcactctagtaccaggacttcggagcctcgtgctgggcggcaaacgagctgttaaacgaggagtggttaacctcgtcaagtatggccggtaaaaatcagagccagaagaaaaagaaaagtacggctccaatggggaatggccagccagtcaatcaactgtgccagttgctgggtgcaatgataaagtcccagcgccagcaacctaggggaggacaggctaaaaagaaaaagcctgagaagccacattttcccctggctgcagaagatgacatccggcaccacctcacccaaactgaacgctccctctgcttgcaatcgatccagacggctttcaatcaaggcgcaggaactgcgtcgctttcatccagcgggaaggtcagtttccaggttgagtttatgctgccggttgctcatacagtgcgcctgattcgcgtgacttctacatccgccagtcagggtgcaaattaatttgacagtcaggtgaatggccgcgattggcgtgtggcctctgagtcacctattcaattagggcgatcacatgggggtcatacttaatcaggcaggaaccatgtgaccgaaattaaaaaaaaaaaaaaaaaaaaaaaaaaaaaaaaaaaaaaaaatctagatttaa

SEQ ID NO: 23 - DNA, 32 bp, Porcine reproductive and respiratory syndrome virus
atattggcgcgcctaatacgactcactatagg

SEQ ID NO: 24 - DNA, 27 bp, Porcine reproductive and respiratory syndrome virus
ggcgcgcctaatacgactcactatagg

SEQ ID NO: 25 - DNA, 18036 bp, Porcine reproductive and respiratory syndrome virus
gcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccttaataagatgatcttcttgagatcgttttggtctgcgcgtaatctcttgctctgaaaacgaaaaaaccgccttgcagggcggtttttcgaaggttctctgagctaccaactctttgaaccgaggtaactggcttggaggagcgcagtcaccaaaacttgtcctttcagtttagccttaaccggcgcatgacttcaagactaactcctctaaatcaattaccagtggctgctgccagtggtgcttttgcatgtctttccgggttggactcaagacgatagttaccggataaggcgcagcggtcggactgaacggggggttcgtgcatacagtccagcttggagcgaactgcctacccggaactgagtgtcaggcgtggaatgagacaaacgcggccataacagcggaatgacaccggtaaaccgaaaggcaggaacaggagagcgcacgagggagccgccagggggaaacgcctggtatctttatagtcctgtcgggtttcgccaccactgatttgagcgtcagatttcgtgatgcttgtcaggggggcggagcctatggaaaaacggctttgccgcggccctctcacttccctgttaagtatcttcctggcatcttccaggaaatctccgccccgttcgtaagccatttccgctcgccgcagtcgaacgaccgagcgtagcgagtcagtgagcgaggaagcggaatatatcctgtatcacatattctgctgacgcaccggtgcagccttttttctcctgccacatgaagcacttcactgacaccctcatcagtgccaacatagtaagccagtatacactccgctagcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcagcgctcaaagatgcaggggtaaaagctaaccgcatctttaccgacaaggcatccggcagttcaacagatcgggaagggctggatttgctgaggatgaaggtggaggaaggtgatgtcattctggtgaagaagctcgaccgtcttggccgcgacaccgccgacatgatccaactgataaaagagtttgatgctcagggtgtagcggttcggtttattgacgacgggatcagtaccgacggtgatatggggcaaatggtggtcaccatcctgtcggctgtggcacaggctgaacgccggaggatccatattggcgcgcctaatacgactcactataggatgatgtgtagggtatcccccctacatacacaacactttttgtgtttgtgtactttggaggcgtgggtacagccccgccccaccccttggcccctgttctagcccaacaggtatccttctccctcggggcgagtgcgccgcctgctgctcccttgcagtgggaaggacctcccgagtatttccggagagcacctgctttacgggatctccaccctttaaccatgtctgggacgttctcccggtgcatgtgcaccccggctgcccgggtattttggaacgccggccaagtcttttgcacacggtgtctcagtgcgcggcctcttctctctccggaacttcaggacactgacctcggtgtagttggattgttttacaagcctaaggacaagattcactggaaagttcctatcggcattcctcaggtggagtgtactccatccgggtgctgctggctctcagccgtattccctttggcgcgcatgacttccggtaatcacaacttcctccaacgacttgttaaggttgctgatgttttgtatcgcgatggttgcttggcgcctcgacacctccgtgaactccaagtttacgagcgcggttgtagctggtacccaattacggggcccgtacccggaatgggtttgtttgcgaactccatgcacgtgtctgaccagccgttccctggtgccacccatgtgttgactaactcgcctctgcctcagcgggcgtgccggcagccgttctgtccatttgaggaagctcattctgacgtttacaggtggaagaaatttgtgatttttacggactcctctcccaacggtcgatttcgcatgatgtggacgccggaatccgatgactcagccgccctggaggtgctgccgcccgagttagaacgtcaggtcgagatcctcactcggagttttcccgctcatcaccctatcaacctagctgactgggagctcactgagtcccctgagaacggtttttctttcggcacgtcccattcttgcggccacatcgtccagaaccccaacgtgtttgacggcaagtgctggctcacctgctttttgggccaatcggctgaagtgtgctaccacgaggaacatctagctaacgccctcggttaccaaaccaagtggggcgtgcatggtaagtacctccaacgcaggcttcaagtccgcggcatgcgtgctgtggtcgatcctgacggccctattcacgttgaagcgctgtcttgctcccagtcttgggtcaggcacctgactctgaataatgatgtcaccccaggattcgttcgcctgacatccatccgcattgtgtccaacacagaacccaccgctttccggatctttcggtttggagcacataagtggtatggcgctgccggcaaacgggctcgtgccaaacgtgccaccaaaagtgggaaggattcggccctcgctcccaagattgccccaccggtccccacctgtggaatcaccacctactctccaccgacagacgggtcttgtggttggcacgttcttgccgccatagtgaatcggatgataaacggtgactttacgtcccccctgcctcagtacaacagaccagaggatgattgggcttctgattatgatcttgctcaggcgattcaatgtttacaactgcctgccaccgtggttcggaatcgcgcctgtcctaacgccaagtacctcataaagctaaacggggttcactgggaagtagaggtgagatctggaatggctcctcgttccctttctcgtgaatgtgtagttggcgtttgctctgaaggctgtgtcgcaccgccttatccagcggacgggcttcctaaacgtgcactcgaggccttggcgtctgcctacagactaccctcagattgtgttagctctggtattgctgactttcttgctgatccacctcctcaggaattctggactctcgacaaaatgttgacctccccgtcaccggagcggtccggcttctccagcttgtataaattactcttagaggttgttccgcaaaaatgtggtgctacggaaggggctttcgtctatgctgttgagaggatgttaaaggactgtccgagccccgaacaggccatggcccttctggcaaaaattaaagttccatcctcaaaggccccgtctgtgtccttggacgagtgttttcctgcgggtgttccagccgacttcgagccagcatttcaggaaaggccccaaagtcccggtgctgctgtcgccctgtgttcaccggacgcaaaagggttcgagggaacagcctcggaagaagctcaagagagtggccataaggccgtccacgctgtaccccttgccgaaggtcccaataatgaacaggtacaggtggttgctggtgagcagctagagctcggcggttgtggtttggcaatcgggagtgctcagtcctcttcagactccaagagagaaaacatgcacaatagccgggaagacgaaccattggatttgtcccacccagcaccggctgccacgacgacccttgtgggagagcaaacacccgacaacccaggttctgatgccagtgctctccccatcgccgttcgaggatttgtcccgacagggcccatactccgtcatgttgagcactgcggcacagagtcaggcgacagcagttcgcctttggatctgtcttttgcgcaaacgttggaccagcctttagatctatccttggccgcttggccggtgaaggccaccgcgtctgatcctggctgggtccgcggtaggtgcgagcctgtctttttaaagcctcggaaagctttctctgatggcgattcggcccttcagttcggggagctttctgagtccagctctgtcatcgagtttgaccagacaaaagatactctggtggctgacgcccctgttgacttgacgacttcgaacgaggccctctctgcagtcgacccttccgaatttgtcgaactcaggcgcccgcgtcattccgcacaagccttaattgaccgaggcggtccacttgctgatgtccatgcgaaaataaagaaccgggtgtatgaacagtgcctccaagcttgtgagcctggtagtcgtgcaaccccagccaccagggagtggctcgacaaaatgtgggatagggtggacatgaaaacttggcgctgcacttcacagttccaggccggtcgcattcttgcgtccctcaaatttcttcctgacatgattcaagacacgccgcctcctgtccccaagaagaaccgagctagtgacagtgccggtctgaagcaactggtggcacggtgggataagaaattgagtgtaaccccccccccaaaatcggctgggttagtgcttgaccagaccgtccctccgcctacggatatccagcaagaggatgccaccccctccgacgggttatcccatgcatcggatttttctagtcgagtgagcacgagctggagttggaaaggccttatgctttccggcacccgtctcgcggggtctgctggtcagcgcctcatgacatgggtttttgaagtttactcccatctcccagcttttatactcacacttttctcgccgcggggctctatggctccaggcgattggttgtttgcaggtgttgttttacttgctctcttgctctgtcgttcttacccaatactcggatgccttcccttactgggtgtcttctctggttctttgcggcgtgttcgtctgggtgtttttggttcttggatggcttttgctgtatttttattctcgactccatccaacccagtcggttcttcttgtgaccacgattcgccggaatgtcatgctgagcttttagctctagagcagcgccaactttgggaacctgtgcgcggccttgtggttggcccctcaggtctcttatgtgtcatccttggcaagttactcggtgggtcacgtcatctctggcatgttatcctacgtttatgcatgcttacagatttggccctttctcttgtttatgtggtgtcccaagggcgttgtcacaagtgttggggaaagtgtataaggacagctcctgctgaggtggctctcaatgtatttcctttctcgcgcgccactcgcaactctctcacatccttgtgtgatcggttccaaactcctaaaggagttgatcccgtgcacttggcaacgggttggcgcgggtgttggcgtggtgagagtcccatccatcaaccacaccaaaagcccatagcttatgccaatttggatgaaaagaaaatatctgctcaaacggtggttgctgtcccatacgaccccagtcaggctatcaaatgtctgaaggttctgcaggcgggaggggctatcgtggaccagcctacgcctgaagttgttcgtgtgtctgaaatccccttttcagccccatttttcccaaaagttccagtcaacccagattgcaggattgtggtggattcagatacttttgtggctgcagtccgctgcggttactcgacagcacaactggtcctaggccggggcaactttgccaagttgaatcagaccccccttagggactctgcctccaccaaaacgactggtggggcctcttatactcttgctgtggctcaagtgtctgtgtggactcttgttcatttcatcctcggtctttggttcacatcacctcaagtgtgtggccgaggaaccgctgacccatggtgttcaaatcccttttcgtatcctgcctacggccctggagttgtgtgctcctctcgactttgtgtgtctgccgatggggtcaccctgccattgttctcagctgtggcacaactctccggtagagaggtagggatttttattttagtgcttgtttccttgactgccttggcccatcgcctggctcttaaggcagacatgttagtggtcttttcagctttttgtgcttacgcctggcccatgagctcctggttaatctgcttctttcctatactcttaaagtgggttacccttcaccccctcactatgctttgggtgcactcattcttggtgttttgtatgccagcagccggcatcctctcactagggataactggccttctctgggcagttggccgctttacccaggttgccggaattattacaccttatgacatccaccagtatacctctgggccacgcggtgcagccgctgtagccacagccccagaaggcacttatatggccgccgtccggagagctgctttaactggacgaactttgatcttcaccccgtctgcggtcggatcccttcttgaaggtgctttcaggactcataaaccctgccttaacaccgtgaatgttgtgggttcttcccttggttctggaggggtttttaccattgatggcagaaagaccgtcgtcactgctgctcatgtgttgaacggcgacacagctagagttaccggcgactcttacaaccgcatgcacacttttaagaccagtggcgattatgcctggtcccatgctgatgactggcagggcgttgcccctgtggtcaaggttgcgaaggggtatcgcggtcgtgcctactggcaaacatcaaccggtgtcgaacccggcgtcattggggaagggttcgccttctgtttcaccaactgtggcgattcggggtcacccgtcatctcagaatctggtgatctcatcggaatccataccggttcaaacaaactcggttctggtcttgtgacgacccctgaaggggaaacctgcgccatcaaagaaaccaagctctctgacctttccagacattttgcgggcccgagcgtccctcttggggacattaaattgagtccggccatcgtccctgatgtaacatctattccgagtgacttggcatcgctcctagcttccgtccctgtaatggaaggcggcctctcgaccgttcaacttctgtgtgtctttttccttctctggcgcatgatgggccatgcctggacacccattgttgccgtgggcttctttttgctgaatgaaattcttccagcagttttggtccgagccgtgttttcctttgcactctttattcttgcatgggccaccccctggtccgcacaggtgttaatgattagactcctcacggcatccctcaaccgcaacaagttgtctctggcgttctacgcacttgggggtgtcgtcggtttggccgctgaaatcggggcttttgccggcaggctgcctgaattgtctcaagctctttcgacatactgtttcttacctagggtccttgccatggccagttatgttcccatcatcatcattggtggactccatgccctcggtgtgattctgtggttgttcaaataccggtgcctccacaacatgctggttggtgatgggagtttctcaagcgctttcttcctacggtattttgcagagggtaatcttagaaaaggtgtttcacagtcttgtggcatgagtaacgagtccctgacggctgctctagcttgcaagttgtcgcaggctgaccttgactttttgtccagcttaacgaacttcaagtgctttgtatctgcttcaaacatgaaaaatgctgccggccagtatattgaagcagcgtatgccaaggccctgcgccaagagttggcctccctagttcaggttgacaaaatgaaaggaattttgtctaagcttgaggcctttgctgaaacagccactccgtcccttgacgcaggtgacgtggttgttctgcttgggcaacatcctcacggatccatcctcgatattaatgtggggactgaaaggaaaactgtgtccgtgcaagagacccggagcttaggtggttccaaattcagtgtttgcactgtcgtgtccaacacacccgtggacgccttaactggcatcccactccagacaccaacccctctttttgagaatggtccgcgtcaccgtggtgaggaagacgatcttagagtcgagaggatgaagaaacactgtgtgtccctcggcttccacaacattaatggcaaagtttactgcaaaatttgggacaagtccaccggtgataccttttataccgatgattcccggtacacccaagaccttgcattccaggacaggtcagccgactacagagacagggattatgagggtgtgcaaaccgccccccaacagggctttgatccaaagtctgaaacccctattggcactgtggtgatcggcggtatcacgtataacaggtacctgatcaaaggtaaggaggtcttggttcccaagcctgacaactgccttgaagctgccaagctgtcccttgagcaagctctcgctgggatgggccaaacttgcgaccttacagctgccgaggtggaaaagttgaggcgcatcattagccagctccaaggtttgaccactgaacaggctttaaactgttagccgccagcggcttgacccgctgtggccgcggcggcttagttgtaactgaaacagcggtaaaaatcgtaaagtaccacagcagaactttcaccctaggccctctggacctgaaagtcacctccgaggctgaggtaaagaaatcaactgagcagggccacgctgttgtggcaaacttatgttctggtgtcatcttgatgagacctcacccaccgtcccttgttgatgttcttctgaaacccggacttgacacaaaacccggcattcaaccagggcatggggccgggaatatgggcgtagacggctctacttgggattttgaaaccgcacccacaaaggcagaacttgagttgtccaaacaaataattcaagcatgtgaagttaggcgcggggacgccccgaacctccaactcccttacaagctctatcctgttagaggggatcctgagcggcatgggggccgccttatcaataccaggtttggagatctatcttacaaaacccctcaagacaccaagtccgcaatccatgcggcttgttgcctgcaccccaacggggcccctgtgtctgatggtaagtcaacactaggtaccacccttcaacatggtttcgaactttatgtccccactgtgccctatagtgtcatggagtacctcgattcacgccctgacacccctttcatgtgcactaaacatggtacttccaaggctgctgcagaagacctccaaaaatacgacctatctactcaaggatttgtcctgcccggggtcttacgccttgtacgcagattcatctttggccatattggtaaggcaccgccattgttcctcccgtcaacctatcccgctaaaaattctatggcagggatcaatggccagaggttcccaacaaaggacgtccagagcatacctgaaattgacgaaatgtgtgcccgcgccgtcaaggagaattggcaaactgtgacaccttgtaccctcaagaaacagtactgttccaagcccaaaaccaggaccatcctgggcaccaacaactttattgccctggctcaccgatcggcgctcagtggtgtcacccaggcattcatgaagaaggcttggaagtccccgattgccttgggaaaaaacaaattcaaggagctgcattgcactgtcgccggcaggtgtcttgaagccgacttggcctcctgtgaccgcagcacccccgccattgtgaggtggttcgtcgccaacctcctgtatgaacttgcaggatgtgaagagtacttgcctagctatgtgcttaactgctgccatgaccttgtggcaacacaggatggtgccttcacaaaacgcggtggcctgtcgtccggggaccccgtcaccagtgtgtctaacaccgtatattcactgataatctatgcccagcacatggtgttgtcggccttaaaaatgggtcatgaaatcggtctcaagttcctcgaggaacagctcaaattcgaggacctcctcgaaatccagcctatgttggtctattctgatgaccttgtcttgtacgctgaaaggcccacttttcctaattatcactggtgggtcgagcaccttgacctaatgctgggtttcagaacggacccaaagaagacagtcataactgataaacccagcttcctcggctgcagaattgaggcggggcgacagctggtccctaatcgcgaccgcatcctggctgctctcgcatatcacatgaaggcgcagaacgcctcagagtattatgcgtctgctgccgcaatcctgatggattcatgtgcttgcattgatcatgaccctgagtggtatgaggacctcatctgcggtatcgcccgatgcgcccgccaggatggttatagtttcccaggcccggcatttttcatgtccatgtgggaaaagctgagaagtcacaatgaagggaagaaatttcgacactgcggcatctgcgacgccaaagccgaccatgcatccgcctgtgggcttgatttgtgtttgttccactcacactttcatcaacactgccccgtcactctgagctgtggtcatcatgccggttcaagggaatgttcgcagtgtcagtcacctgttggggctggcagatctcctcttgatgccgtgctaaaacaaatcctgtacaaacctcctcgtacagtcatcatgaaggtgggtaacaaaacaacggccctcgatccggggaggtaccagtcccgtcgaggtcttgttgcagtcaagaggggtattgcaggcaatgaagttgatcttcctgatggggactaccaagtagtgcctcttttaccaacttgtaaagacataaacatggtaaaggtggcttgcaatgtactactcagtaagttcatagtggggccaccaggttccggaaagaccacctggttactgagtcaagtccaggacgatgatgtcatttacacacccacccatcagaccatgtttgatatagtcagtgctctcaaagtttgcaggtattctattccaggagcctcaggacttcctttcccaccacctgccaggtccgggccgtgggttaggctcgtggccagcgggcacgtccccggccgaacatcatacctcgatgaggctggatattgtaatcatctggacattctcagactgctttccaaaacacccctcgtgtgtttgggtgaccttcaacaacttcaccctgtcggctttgactcctactgttatgtgtttgatcagatgcctcaaaagcaactgaccactatttatagatttggccctaacatctgcgcagccatccagccttgttacagggagaagcttgaatctaaggctaggaacaccagggtggtctttaccacctggcctgtggcctttggtcaggtgctgacaccataccataaagatcgcatcggctctgcgataaccatagactcatcccagggggccactttcgacattgtgacattgcatctaccatcaccaaagtccctaaataaatcccgagcacttgtagccatcactcgggcaagacacgggttgttcatttatgaccctcacaaccagctccaggagtttttcaacctgatccctgagcgcactgattgcaaccttgtgttcagccgtggggatgatctggtagttcttagtgcggacaatgcagtcacaactgtagcgaaggccctagggacaggtccatctcgatttcgagtatcagacccgaggtgcaagtctctcttagctgcttgttcggccagtctggaggggagctgtatgccactaccacaagtggcacataacctggggttttacttctccccagacagtccagcatttgcacctctgccaaaggagttagcgccacattggccagtggttactcaccagaacaatcgggcgtggcccgatcgacttgtcgctagtatgcgcccaattgatgcccgctacagcaagccaatggtcggtgcagggtatgtggtcgggccgtccacctttcttggtactcctggtgtagtgtcatactacctcacgctatacatcaggggtgagccccaggccttgccagagacactcgtttcaacaggacgcatagccactgactgccgggagtatctcgacgcggctgaggaagaggcagcaaaagaactcccccacgcattcattggcgatgtcaaaggtaccacggtcggggggtgtcaccacatcacatcaaaatacctacccaggaccctgcctaaggactctgttgctgtagttggagtaagctcgcccggcagggctgctaaagccatgtgcactctcactgatgtgtatctccccgaactccggccatacctgcaacctgagacggcgtcgaaatgctggaaactcaaattagacttcagggacgtccgactaatggtctggaaaggagccaccgcccatttccagttggaaggacttacatggtcagcgctgcctgactatgccaggtttattcagcttcccaaggacgccgttgtgtacattgatccgtgtataggaccggcaacagccaaccgcaaggtcgtgcgaaccacagactggcgggccgacctggcagtgacaccgtatgattacggtgcccagaacattttgacaacagcctggttcgaggacctcgggccgcagtggaagattttggggttgcagcccttcaggcgggcatttggctttgaaaatactgaggattgggcaatccttgcacgccgtatgagtgacggcaaagactacactgactacaactgggattgtgttcgagaacgcccacacgccatctacgggcgtgctcgtgaccatacatatcattttgcccccggcacggaattgcaggtagagctgggtaaaccccggctgccgcctggacgagagccgtaaacttggagtgatgcaatggggtcactgtggagtaaaatcagccagctgttcgtggatgccttcactgagtttcttgtcagtgtggttgatattgtcattttccttgccatactgtttgggttcaccgtcgcaggatggttattggtctttcttctcagagtggtttgctccgcgcttctccgttcgcgctctgccattcactctcccgaactatcgaaggtcctatgaaagcttgttgcccaactgcaggccggatgtcccacaatttgcatttaagcacccattgggtatactttggcacatgcgagtttcccacctgattgatgagatggtctctcgccgcatttaccagaccatggaacattcaggtcaagcggcctggaaatatgtggtcggtgaggccactctcacgaagctatcaaagcttgatatagttactcatttccaacatctggccgcagtagaggcggattcttgccgctttctcagctcacgactcgtgatgctaaaaaatcttgccgttggcaatgtgagcctacagtacaacaccacgttggatcgcgttgaactcattttccccacgccaggtacgaggcccaagttgaccgacttcagacaatggctcatcagtgtgcatgcttccattttttcctctgtggcttcatctgttaccttgttcatagtgctttggctgcgaattccagctctacgctatgtttttggtttccattggcccacggcaacacatcattcgagctgaccatcaattataccatatgcatgccctgtcttaccagtcaagcagctcgccaaaggctcgagcccggtcgtaacatgtggtgcagaatagggcatgataggtgtgaggagcgtgaccatgatgagttgttaatgtccatcccgtccgggtacgacaacctcaaacttgagggatattatgcttggctggcttttttgtccttttcctacgcggcccaattccatccggagctgttcgggatagggaatgtgtcgcgcgtcttcgtggacaagcgacaccagtttatttgtgccgagcatggtggactcaattcaaccttatctaccgagcacaatatctccgcattatatgcggtatattatcaccaccaaatagacgggggtaattggttccatttggaatggctgcggccgcttttttcctcctggttggtgctcaacatatcatggtttctgaggcgttcgcctgtaagccctgtttctcgacgcatctatcagatattaagaccaacacgaccgcggctgccggtttcatggtccttcagaacatcaattgttcccggcctcacgaggcctcagcaacgcaaggtcaagttccctccagaaagtcgtcccaatgccgtgaagccgtcggtgttccccaatacatcacgataacggccaacgtgaccgacgaatcatatttgtacaacgcggacttgctgatgctttctgcgtgccttttctacgcctcggaaatgagcgagaaaggctttaaagttatctttgggaatgtctctggcgttgtttctgcttgtgtcaatttcacagattatgtggcccatgtgacccaacatacccagcagcatcatctggtgattaatcacatccggttactgcacttcctgacaccatctgcaatgaggtgggctacaaccattgcttgtctgttcgccattctcttggcgatatgaaatgttctcacaaattggggcattccttgactccgcactcttgcttctggtggctttttttgctgtgtaccggcttgtcctggtcctttgccgatggcaacggcaacaactcgacataccaatacatatataatttgacgatatgcgagttgaatgggaccaattggctgtccggccattttgaatgggcagttgagacctttgtgctttacccggttgtcactcatatcctctcactgggttttctcacgacaagtcatttttttgacgcgctcggtctcggcgctgtatccactgcaggatttgtcggagggcggtatgtacttagcagcgtctacggcgcttgtgctttcgcagcgttcgtatgcttcgtcatccgtgctgctaaaaattgcatggcctgccgctatgcccgtacccggttcaccaacttcattgtggacgaccgggggggagttcatagatggaagtctccaatagtggtagaaaaactgggcaaagccgaaattggcggcaaccttgtcaccatcaaacatgtcgtcctcgaaggggttaaagctcaacccttgacgagaacttcggccgagcaatgggaggcctagataatttttgcaacgatcctaccgccgcacaaaagatcgtgctagccttcagcatcacatacacacctataatgatatacgcccttaaggtgtcacgcggccgactcctggggctgttgcacatcctaatatttctgaactgttcctttacattcggatacatgacatatgtgcattttcattctacccaccgtgtcgcacttaccctgggggctgttgtcgcccttttgtggggtgtctacagcctcacagagtcatggaagtttatcacttccagatgcagattgtgttgcctcggccggcgatacattctggcccctgcccatcacgtagaaagtgctgcaggtctccattcaatctcagcgtctggtaaccgagcatacgctgtgagaaagcccggactaacatcagtgaacggcactctagtaccaggacttcggagcctcgtgctgggcggcaaacgagctgttaaacgaggagtggttaacctcgtcaagtatggccggtaaaaatcagagccagaagaaaaagaaaagtacggctccaatggggaatggccagccagtcaatcaactgtgccagttgctgggtgcaatgataaagtcccagcgccagcaacctaggggaggacaggctaaaaagaaaaagcctgagaagccacattttcccctggctgcagaagatgacatccggcaccacctcacccaaactgaacgctccctctgcttgcaatcgatccagacggctttcaatcaaggcgcaggaactgcgtcgctttcatccagcgggaaggtcagtttccaggttgagtttatgctgccggttgctcatacagtgcgcctgattcgcgtgacttctacatccgccagtcagggtgcaaattaatttgacagtcaggtgaatggccgcgattggcgtgtggcctctgagtcacctattcaattagggcgatcacatgggggtcatacttaatcaggcaggaaccatgtgaccgaaattaaaaaaaaaaaaaaaaaaaaaaaaaaaaaaaaaaaaaaaaatctagatttaa

SEQ ID NO: 26 - DNA, 18036 bp, Porcine reproductive and respiratory syndrome virus
gcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccttaataagatgatcttcttgagatcgttttggtctgcgcgtaatctcttgctctgaaaacgaaaaaaccgccttgcagggcggtttttcgaaggttctctgagctaccaactctttgaaccgaggtaactggcttggaggagcgcagtcaccaaaacttgtcctttcagtttagccttaaccggcgcatgacttcaagactaactcctctaaatcaattaccagtggctgctgccagtggtgcttttgcatgtctttccgggttggactcaagacgatagttaccggataaggcgcagcggtcggactgaacggggggttcgtgcatacagtccagcttggagcgaactgcctacccggaactgagtgtcaggcgtggaatgagacaaacgcggccataacagcggaatgacaccggtaaaccgaaaggcaggaacaggagagcgcacgagggagccgccagggggaaacgcctggtatctttatagtcctgtcgggtttcgccaccactgatttgagcgtcagatttcgtgatgcttgtcaggggggcggagcctatggaaaaacggctttgccgcggccctctcacttccctgttaagtatcttcctggcatcttccaggaaatctccgccccgttcgtaagccatttccgctcgccgcagtcgaacgaccgagcgtagcgagtcagtgagcgaggaagcggaatatatcctgtatcacatattctgctgacgcaccggtgcagccttttttctcctgccacatgaagcacttcactgacaccctcatcagtgccaacatagtaagccagtatacactccgctagcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcagcgctcaaagatgcaggggtaaaagctaaccgcatctttaccgacaaggcatccggcagttcaacagatcgggaagggctggatttgctgaggatgaaggtggaggaaggtgatgtcattctggtgaagaagctcgaccgtcttggccgcgacaccgccgacatgatccaactgataaaagagtttgatgctcagggtgtagcggttcggtttattgacgacgggatcagtaccgacggtgatatggggcaaatggtggtcaccatcctgtcggctgtggcacaggctgaacgccggaggatccatattggcgcgcctaatacgactcactataggatgatgtgtagggtatcccccctacatacacaacactttttgtgtttgtgtactttggaggcgtgggtacagccccgccccaccccttggcccctgttctagcccaacaggtatccttctccctcggggcgagtgcgccgcctgctgctcccttgcagtgggaaggacctcccgagtatttccggagagcacctgctttacgggatctccaccctttaaccatgtctgggacgttctcccggtgcatgtgcaccccggctgcccgggtattttggaacgccggccaagtcttttgcacacggtgtctcagtgcgcggcctcttctctctccggaacttcaggacactgacctcggtgtagttggattgttttacaagcctaaggacaagattcactggaaagttcctatcggcattcctcaggtggagtgtactccatccgggtgctgctggctctcagccgtattccctttggcgcgcatgacttccggtaatcacaacttcctccaacgacttgttaaggttgctgatgttttgtatcgcgatggttgcttggcgcctcgacacctccgtgaactccaagtttacgagcgcggttgtagctggtacccaattacggggcccgtacccggaatgggtttgtttgcgaactccatgcacgtgtctgaccagccgttccctggtgccacccatgtgttgactaactcgcctctgcctcagcgggcgtgccggcagccgttctgtccatttgaggaagctcattctgacgtttacaggtggaagaaatttgtgatttttacggactcctctcccaacggtcgatttcgcatgatgtggacgccggaatccgatgactcagccgccctggaggtgctgccgcccgagttagaacgtcaggtcgagatcctcactcggagttttcccgctcatcaccctatcaacctagctgactgggagctcactgagtcccctgagaacggtttttctttcggcacgtcccattcttgcggccacatcgtccagaaccccaacgtgtttgacggcaagtgctggctcacctgctttttgggccaatcggctgaagtgtgctaccacgaggaacatctagctaacgccctcggttaccaaaccaagtggggcgtgcatggtaagtacctccaacgcaggcttcaagtccgcggcatgcgtgctgtggtcgatcctgacggccctattcacgttgaagcgctgtcttgctcccagtcttgggtcaggcacctgactctgaataatgatgtcaccccaggattcgttcgcctgacatccatccgcattgtgtccaacacagaacccaccgctttccggatctttcggtttggagcacataagtggtatggcgctgccggcaaacgggctcgtgccaaacgtgccaccaaaagtgggaaggattcggccctcgctcccaagattgccccaccggtccccacctgtggaatcaccacctactctccaccgacagacgggtcttgtggttggcacgttcttgccgccatagtgaatcggatgataaacggtgactttacgtcccccctgcctcagtacaacagaccagaggatgattgggcttctgattatgatcttgctcaggcgattcaatgtttacaactgcctgccaccgtggttcggaatcgcgcctgtcctaacgccaagtacctcataaagctaaacggggttcactgggaagtagaggtgagatctggaatggctcctcgttccctttctcgtgaatgtgtagttggcgtttgctctgaaggctgtgtcgcaccgccttatccagcggacgggcttcctaaacgtgcactcgaggccttggcgtctgcctacagactaccctcagattgtgttagctctggtattgctgactttcttgctgatccacctcctcaggaattctggactctcgacaaaatgttgacctccccgtcaccggagcggtccggcttctccagcttgtataaattactcttagaggttgttccgcaaaaatgtggtgctacggaaggggctttcgtctatgctgttgagaggatgttaaaggactgtccgagccccgaacaggccatggcccttctggcaaaaattaaagttccatcctcaaaggccccgtctgtgtccttggacgagtgttttcctgcgggtgttccagccgacttcgagccagcatttcaggaaaggccccaaagtcccggtgctgctgtcgccctgtgttcaccggacgcaaaagggttcgagggaacagcctcggaagaagctcaagagagtggccataaggccgtccacgctgtaccccttgccgaaggtcccaataatgaacaggtacaggtggttgctggtgagcagctagagctcggcggttgtggtttggcaatcgggagtgctcagtcctcttcagactccaagagagaaaacatgcacaatagccgggaagacgaaccattggatttgtcccacccagcaccggctgccacgacgacccttgtgggagagcaaacacccgacaacccaggttctgatgccagtgctctccccatcgccgttcgaggatttgtcccgacagggcccatactccgtcatgttgagcactgcggcacagagtcaggcgacagcagttcgcctttggatctgtcttttgcgcaaacgttggaccagcctttagatctatccttggccgcttggccggtgaaggccaccgcgtctgatcctggctgggtccgcggtaggtgcgagcctgtctttttaaagcctcggaaagctttctctgatggcgattcggcccttcagttcggggagctttctgagtccagctctgtcatcgagtttgaccagacaaaagatactctggtggctgacgcccctgttgacttgacgacttcgaacgaggccctctctgcagtcgacccttccgaatttgtcgaactcaggcgcccgcgtcattccgcacaagccttaattgaccgaggcggtccacttgctgatgtccatgcgaaaataaagaaccgggtgtatgaacagtgcctccaagcttgtgagcctggtagtcgtgcaaccccagccaccagggagtggctcgacaaaatgtgggatagggtggacatgaaaacttggcgctgcacttcacagttccaggccggtcgcattcttgcgtccctcaaatttcttcctgacatgattcaagacacgccgcctcctgtccccaagaagaaccgagctagtgacagtgccggtctgaagcaactggtggcacggtgggataagaaattgagtgtaaccccccccccaaaatcggctgggttagtgcttgaccagaccgtccctccgcctacggatatccagcaagaggatgccaccccctccgacgggttatcccatgcatcggatttttctagtcgagtgagcacgagctggagttggaaaggccttatgctttccggcacccgtctcgcggggtctgctggtcagcgcctcatgacatgggtattcgaagtttatagtcatttgccagcttttatactgacacttttctcgccgcggggctctatggctccaggcgattggttgtttgcaggtgttgttttacttgctctcttgctctgtcgttcttacccaatactcggatgccttcccttactgggtgtcttctctggttctttgcggcgtgttcgtctgggtgtttttggttcttggatggcttttgctgtatttttattctcgactccatccaacccagtcggttcttcttgtgaccacgattcgccggaatgtcatgctgagcttttggctcttgagcagcgccaactttgggaacctgtgcgcggccttgtggttggcccctcaggtctcttatgtgtcatccttggcaagttactcggtgggtcacgtcatctctggcatgttatcctacgtttatgcatgcttacagatttggccctttctcttgtttatgtggtgtcccaagggcgttgtcacaagtgttggggaaagtgtataaggacagctcctgctgaggtggctctcaatgtatttcctttctcgcgcgccactcgcaactctctcacatccttgtgtgatcggttccaaactcctaaaggagttgatcccgtgcacttggcaacgggttggcgcgggtgttggcgtggtgagagtcccatccatcaaccacaccaaaagcccatagcttatgccaatttggatgaaaagaaaatatctgctcaaacggtggttgctgtcccatacgaccccagtcaggctatcaaatgtctgaaggttctgcaggcgggaggggctatcgtggaccagcctacgcctgaagttgttcgtgtgtctgaaatccccttttcagccccatttttcccaaaagttccagtcaacccagattgcaggattgtggtggattcagatacttttgtggctgcagtccgctgcggttactcgacagcacaactggtcctaggccggggcaactttgccaagttgaatcagaccccccttagggactctgcctccaccaaaacgactggtggggcctcttatactcttgctgtggctcaagtgtctgtgtggactcttgttcatttcatcctcggtctttggttcacatcacctcaagtgtgtggccgaggaaccgctgacccatggtgttcaaatcccttttcgtatcctgcctacggccctggagttgtgtgctcctctcgactttgtgtgtctgccgatggggtcaccctgccattgttctcagctgtggcacaactctccggtagagaggtagggatttttattttagtgcttgtttccttgactgccttggcccatcgcctggctcttaaggcagacatgttagtggtcttttcagctttttgtgcttacgcctggcccatgagctcctggttaatctgcttctttcctatactcttaaagtgggttacccttcaccccctcactatgctttgggtgcactcattcttggtgttttgtatgccagcagccggcatcctctcactagggataactggccttctctgggcagttggccgctttacccaggttgccggaattattacaccttatgacatccaccagtatacctctgggccacgcggtgcagccgctgtagccacagccccagaaggcacttatatggccgccgtccggagagctgctttaactggacgaactttgatcttcaccccgtctgcggtcggatcccttcttgaaggtgctttcaggactcataaaccctgccttaacaccgtgaatgttgtgggttcttcccttggttctggaggggtttttaccattgatggcagaaagaccgtcgtcactgctgctcatgtgttgaacggcgacacagctagagttaccggcgactcttacaaccgcatgcacacttttaagaccagtggcgattatgcctggtcccatgctgatgactggcagggcgttgcccctgtggtcaaggttgcgaaggggtatcgcggtcgtgcctactggcaaacatcaaccggtgtcgaacccggcgtcattggggaagggttcgccttctgtttcaccaactgtggcgattcggggtcacccgtcatctcagaatctggtgatctcatcggaatccataccggttcaaacaaactcggttctggtcttgtgacgacccctgaaggggaaacctgcgccatcaaagaaaccaagctctctgacctttccagacattttgcgggcccgagcgtccctcttggggacattaaattgagtccggccatcgtccctgatgtaacatctattccgagtgacttggcatcgctcctagcttccgtccctgtaatggaaggcggcctctcgaccgttcaacttctgtgtgtctttttccttctctggcgcatgatgggccatgcctggacacccattgttgccgtgggcttctttttgctgaatgaaattcttccagcagttttggtccgagccgtgttttcctttgcactctttattcttgcatgggccaccccctggtccgcacaggtgttaatgattagactcctcacggcatccctcaaccgcaacaagttgtctctggcgttctacgcacttgggggtgtcgtcggtttggccgctgaaatcggggcttttgccggcaggctgcctgaattgtctcaagctctttcgacatactgtttcttacctagggtccttgccatggccagttatgttcccatcatcatcattggtggactccatgccctcggtgtgattctgtggttgttcaaataccggtgcctccacaacatgctggttggtgatgggagtttctcaagcgctttcttcctacggtattttgcagagggtaatcttagaaaaggtgtttcacagtcttgtggcatgagtaacgagtccctgacggctgctctagcttgcaagttgtcgcaggctgaccttgactttttgtccagcttaacgaacttcaagtgctttgtatctgcttcaaacatgaaaaatgctgccggccagtatattgaagcagcgtatgccaaggccctgcgccaagagttggcctccctagttcaggttgacaaaatgaaaggaattttgtctaagcttgaggcctttgctgaaacagccactccgtcccttgacgcaggtgacgtggttgttctgcttgggcaacatcctcacggatccatcctcgatattaatgtggggactgaaaggaaaactgtgtccgtgcaagagacccggagcttaggtggttccaaattcagtgtttgcactgtcgtgtccaacacacccgtggacgccttaactggcatcccactccagacaccaacccctctttttgagaatggtccgcgtcaccgtggtgaggaagacgatcttagagtcgagaggatgaagaaacactgtgtgtccctcggcttccacaacattaatggcaaagtttactgcaaaatttgggacaagtccaccggtgataccttttataccgatgattcccggtacacccaagaccttgcattccaggacaggtcagccgactacagagacagggattatgagggtgtgcaaaccgccccccaacagggctttgatccaaagtctgaaacccctattggcactgtggtgatcggcggtatcacgtataacaggtacctgatcaaaggtaaggaggtcttggttcccaagcctgacaactgccttgaagctgccaagctgtcccttgagcaagctctcgctgggatgggccaaacttgcgaccttacagctgccgaggtggaaaagttgaggcgcatcattagccagctccaaggtttgaccactgaacaggctttaaactgttagccgccagcggcttgacccgctgtggccgcggcggcttagttgtaactgaaacagcggtaaaaatcgtaaagtaccacagcagaactttcaccctaggccctctggacctgaaagtcacctccgaggctgaggtaaagaaatcaactgagcagggccacgctgttgtggcaaacttatgttctggtgtcatcttgatgagacctcacccaccgtcccttgttgatgttcttctgaaacccggacttgacacaaaacccggcattcaaccagggcatggggccgggaatatgggcgtagacggctctacttgggattttgaaaccgcacccacaaaggcagaacttgagttgtccaaacaaataattcaagcatgtgaagttaggcgcggggacgccccgaacctccaactcccttacaagctctatcctgttagaggggatcctgagcggcatgggggccgccttatcaataccaggtttggagatctatcttacaaaacccctcaagacaccaagtccgcaatccatgcggcttgttgcctgcaccccaacggggcccctgtgtctgatggtaagtcaacactaggtaccacccttcaacatggtttcgaactttatgtccccactgtgccctatagtgtcatggagtacctcgattcacgccctgacacccctttcatgtgcactaaacatggtacttccaaggctgctgcagaagacctccaaaaatacgacctatctactcaaggatttgtcctgcccggggtcttacgccttgtacgcagattcatctttggccatattggtaaggcaccgccattgttcctcccgtcaacctatcccgctaaaaattctatggcagggatcaatggccagaggttcccaacaaaggacgtccagagcatacctgaaattgacgaaatgtgtgcccgcgccgtcaaggagaattggcaaactgtgacaccttgtaccctcaagaaacagtactgttccaagcccaaaaccaggaccatcctgggcaccaacaactttattgccctggctcaccgatcggcgctcagtggtgtcacccaggcattcatgaagaaggcttggaagtccccgattgccttgggaaaaaacaaattcaaggagctgcattgcactgtcgccggcaggtgtcttgaagccgacttggcctcctgtgaccgcagcacccccgccattgtgaggtggttcgtcgccaacctcctgtatgaacttgcaggatgtgaagagtacttgcctagctatgtgcttaactgctgccatgaccttgtggcaacacaggatggtgccttcacaaaacgcggtggcctgtcgtccggggaccccgtcaccagtgtgtctaacaccgtatattcactgataatctatgcccagcacatggtgttgtcggccttaaaaatgggtcatgaaatcggtctcaagttcctcgaggaacagctcaaattcgaggacctcctcgaaatccagcctatgttggtctattctgatgaccttgtcttgtacgctgaaaggcccacttttcctaattatcactggtgggtcgagcaccttgacctaatgctgggtttcagaacggacccaaagaagacagtcataactgataaacccagcttcctcggctgcagaattgaggcggggcgacagctggtccctaatcgcgaccgcatcctggctgctctcgcatatcacatgaaggcgcagaacgcctcagagtattatgcgtctgctgccgcaatcctgatggattcatgtgcttgcattgatcatgaccctgagtggtatgaggacctcatctgcggtatcgcccgatgcgcccgccaggatggttatagtttcccaggcccggcatttttcatgtccatgtgggaaaagctgagaagtcacaatgaagggaagaaatttcgacactgcggcatctgcgacgccaaagccgaccatgcatccgcctgtgggcttgatttgtgtttgttccactcacactttcatcaacactgccccgtcactctgagctgtggtcatcatgccggttcaagggaatgttcgcagtgtcagtcacctgttggggctggcagatctcctcttgatgccgtgctaaaacaaatcctgtacaaacctcctcgtacagtcatcatgaaggtgggtaacaaaacaacggccctcgatccggggaggtaccagtcccgtcgaggtcttgttgcagtcaagaggggtattgcaggcaatgaagttgatcttcctgatggggactaccaagtagtgcctcttttaccaacttgtaaagacataaacatggtaaaggtggcttgcaatgtactactcagtaagttcatagtggggccaccaggttccggaaagaccacctggttactgagtcaagtccaggacgatgatgtcatttacacacccacccatcagaccatgtttgatatagtcagtgctctcaaagtttgcaggtattctattccaggagcctcaggacttcctttcccaccacctgccaggtccgggccgtgggttaggctcgtggccagcgggcacgtccccggccgaacatcatacctcgatgaggctggatattgtaatcatctggacattctcagactgctttccaaaacacccctcgtgtgtttgggtgaccttcaacaacttcaccctgtcggctttgactcctactgttatgtgtttgatcagatgcctcaaaagcaactgaccactatttatagatttggccctaacatctgcgcagccatccagccttgttacagggagaagcttgaatctaaggctaggaacaccagggtggtctttaccacctggcctgtggcctttggtcaggtgctgacaccataccataaagatcgcatcggctctgcgataaccatagactcatcccagggggccactttcgacattgtgacattgcatctaccatcaccaaagtccctaaataaatcccgagcacttgtagccatcactcgggcaagacacgggttgttcatttatgaccctcacaaccagctccaggagtttttcaacctgatccctgagcgcactgattgcaaccttgtgttcagccgtggggatgatctggtagttcttagtgcggacaatgcagtcacaactgtagcgaaggccctagggacaggtccatctcgatttcgagtatcagacccgaggtgcaagtctctcttagctgcttgttcggccagtctggaggggagctgtatgccactaccacaagtggcacataacctggggttttacttctccccagacagtccagcatttgcacctctgccaaaggagttagcgccacattggccagtggttactcaccagaacaatcgggcgtggcccgatcgacttgtcgctagtatgcgcccaattgatgcccgctacagcaagccaatggtcggtgcagggtatgtggtcgggccgtccacctttcttggtactcctggtgtagtgtcatactacctcacgctatacatcaggggtgagccccaggccttgccagagacactcgtttcaacaggacgcatagccactgactgccgggagtatctcgacgcggctgaggaagaggcagcaaaagaactcccccacgcattcattggcgatgtcaaaggtaccacggtcggggggtgtcaccacatcacatcaaaatacctacccaggaccctgcctaaggactctgttgctgtagttggagtaagctcgcccggcagggctgctaaagccatgtgcactctcactgatgtgtatctccccgaactccggccatacctgcaacctgagacggcgtcgaaatgctggaaactcaaattagacttcagggacgtccgactaatggtctggaaaggagccaccgcccatttccagttggaaggacttacatggtcagcgctgcctgactatgccaggtttattcagcttcccaaggacgccgttgtgtacattgatccgtgtataggaccggcaacagccaaccgcaaggtcgtgcgaaccacagactggcgggccgacctggcagtgacaccgtatgattacggtgcccagaacattttgacaacagcctggttcgaggacctcgggccgcagtggaagattttggggttgcagcccttcaggcgggcatttggctttgaaaatactgaggattgggcaatccttgcacgccgtatgagtgacggcaaagactacactgactacaactgggattgtgttcgagaacgcccacacgccatctacgggcgtgctcgtgaccatacatatcattttgcccccggcacggaattgcaggtagagctgggtaaaccccggctgccgcctggacgagagccgtaaacttggagtgatgcaatggggtcactgtggagtaaaatcagccagctgttcgtggatgccttcactgagtttcttgtcagtgtggttgatattgtcattttccttgccatactgtttgggttcaccgtcgcaggatggttattggtctttcttctcagagtggtttgctccgcgcttctccgttcgcgctctgccattcactctcccgaactatcgaaggtcctatgaaagcttgttgcccaactgcaggccggatgtcccacaatttgcatttaagcacccattgggtatactttggcacatgcgagtttcccacctgattgatgagatggtctctcgccgcatttaccagaccatggaacattcaggtcaagcggcctggaaatatgtggtcggtgaggccactctcacgaagctatcaaagcttgatatagttactcatttccaacatctggccgcagtagaggcggattcttgccgctttctcagctcacgactcgtgatgctaaaaaatcttgccgttggcaatgtgagcctacagtacaacaccacgttggatcgcgttgaactcattttccccacgccaggtacgaggcccaagttgaccgacttcagacaatggctcatcagtgtgcatgcttccattttttcctctgtggcttcatctgttaccttgttcatagtgctttggctgcgaattccagctctacgctatgtttttggtttccattggcccacggcaacacatcattcgagctgaccatcaattataccatatgcatgccctgtcttaccagtcaagcagctcgccaaaggctcgagcccggtcgtaacatgtggtgcagaatagggcatgataggtgtgaggagcgtgaccatgatgagttgttaatgtccatcccgtccgggtacgacaacctcaaacttgagggatattatgcttggctggcttttttgtccttttcctacgcggcccaattccatccggagctgttcgggatagggaatgtgtcgcgcgtcttcgtggacaagcgacaccagtttatttgtgccgagcatggtggactcaattcaaccttatctaccgagcacaatatctccgcattatatgcggtatattatcaccaccaaatagacgggggtaattggttccatttggaatggctgcggccgcttttttcctcctggttggtgctcaacatatcatggtttctgaggcgttcgcctgtaagccctgtttctcgacgcatctatcagatattaagaccaacacgaccgcggctgccggtttcatggtccttcagaacatcaattgttcccggcctcacgaggcctcagcaacgcaaggtcaagttccctccagaaagtcgtcccaatgccgtgaagccgtcggtgttccccaatacatcacgataacggccaacgtgaccgacgaatcatatttgtacaacgcggacttgctgatgctttctgcgtgccttttctacgcctcggaaatgagcgagaaaggctttaaagttatctttgggaatgtctctggcgttgtttctgcttgtgtcaatttcacagattatgtggcccatgtgacccaacatacccagcagcatcatctggtgattaatcacatccggttactgcacttcctgacaccatctgcaatgaggtgggctacaaccattgcttgtctgttcgccattctcttggcgatatgaaatgttctcacaaattggggcattccttgactccgcactcttgcttctggtggctttttttgctgtgtaccggcttgtcctggtcctttgccgatggcaacggcaacaactcgacataccaatacatatataatttgacgatatgcgagttgaatgggaccaattggctgtccggccattttgaatgggcagttgagacctttgtgctttacccggttgtcactcatatcctctcactgggttttctcacgacaagtcatttttttgacgcgctcggtctcggcgctgtatccactgcaggatttgtcggagggcggtatgtacttagcagcgtctacggcgcttgtgctttcgcagcgttcgtatgcttcgtcatccgtgctgctaaaaattgcatggcctgccgctatgcccgtacccggttcaccaacttcattgtggacgaccgggggggagttcatagatggaagtctccaatagtggtagaaaaactgggcaaagccgaaattggcggcaaccttgtcaccatcaaacatgtcgtcctcgaaggggttaaagctcaacccttgacgagaacttcggccgagcaatgggaggcctagataatttttgcaacgatcctaccgccgcacaaaagatcgtgctagccttcagcatcacatacacacctataatgatatacgcccttaaggtgtcacgcggccgactcctggggctgttgcacatcctaatatttctgaactgttcctttacattcggatacatgacatatgtgcattttcattctacccaccgtgtcgcacttaccctgggggctgttgtcgcccttttgtggggtgtctacagcctcacagagtcatggaagtttatcacttccagatgcagattgtgttgcctcggccggcgatacattctggcccctgcccatcacgtagaaagtgctgcaggtctccattcaatctcagcgtctggtaaccgagcatacgctgtgagaaagcccggactaacatcagtgaacggcactctagtaccaggacttcggagcctcgtgctgggcggcaaacgagctgttaaacgaggagtggttaacctcgtcaagtatggccggtaaaaatcagagccagaagaaaaagaaaagtacggctccaatggggaatggccagccagtcaatcaactgtgccagttgctgggtgcaatgataaagtcccagcgccagcaacctaggggaggacaggctaaaaagaaaaagcctgagaagccacattttcccctggctgcagaagatgacatccggcaccacctcacccaaactgaacgctccctctgcttgcaatcgatccagacggctttcaatcaaggcgcaggaactgcgtcgctttcatccagcgggaaggtcagtttccaggttgagtttatgctgccggttgctcatacagtgcgcctgattcgcgtgacttctacatccgccagtcagggtgcaaattaatttgacagtcaggtgaatggccgcgattggcgtgtggcctctgagtcacctattcaattagggcgatcacatgggggtcatacttaatcaggcaggaaccatgtgaccgaaattaaaaaaaaaaaaaaaaaaaaaaaaaaaaaaaaaaaaaaaaatctagatttaa

SEQ ID NO: 27 - RNA, 48 nt, Porcine reproductive and respiratory syndrome virus
caccagguuuuucucuuguccucccaucuccucgccauguggucuguc

SEQ ID NO: 28 - RNA, 48 nt, Porcine reproductive and respiratory syndrome virus
cgucagguuuuugaccucgucucccaucucccuguuuucuucucacgc

SEQ ID NO: 29 - RNA, 48 nt, Porcine reproductive and respiratory syndrome virus
cgacagguuuuuaaccucgucucccaucucccuguuuucuucucacgc

SEQ ID NO: 30 - RNA, 48 nt, Porcine reproductive and respiratory syndrome virus
acauggguuuuugaaguuuacucccaucucccagcuuuuauacucaca

SEQ ID NO: 31 - RNA, 48 nt, Porcine reproductive and respiratory syndrome virus
cagcggguuuuuggcuuguacccccagcuccuuuccaugcugcuccca

SEQ ID NO: 32 - RNA, 48 nt, Porcine reproductive and respiratory syndrome virus
gaccaggucucucgcuuccaaccccaucuccuggcuuuucucugcuca

SEQ ID NO: 33 - RNA, 48 nt, Porcine reproductive and respiratory syndrome virus; identical to SEQ ID NO: 32

SEQ ID NO: 34 - DNA, 615 bp, Porcine reproductive and respiratory syndrome virus
tctgacgtttacaggtggaagaaatttgtgatttttacggactcctctcccaacggtcgatttcgcatgatgtggacgccggaatccgatgactcagccgccctggaggtgctgccgcccgagttagaacgtcaggtcgagatcctcactcggagttttcccgctcatcaccctatcaacctagctgactgggagctcactgagtcccctgagaacggtttttctttcggcacgtcccattcttgcggccacatcgtccagaaccccaacgtgtttgacggcaagtgctggctcacctgctttttgggccaatcggctgaagtgtgctaccacgaggaacatctagctaacgccctcggttaccaaaccaagtggggcgtgcatggtaagtacctccaacgcaggcttcaagtccgcggcatgcgtgctgtggtcgatcctgacggccctattcacgttgaagcgctgtcttgctcccagtcttgggtcaggcacctgactctgaataatgatgtcaccccaggattcgttcgcctgacatccatccgcattgtgtccaacacagaacccaccgctttccggatctttcggtttggagcacataagtggtatggc

SEQ ID NO: 35 - DNA, 615 bp, Porcine reproductive and respiratory syndrome virus
tcggatgtgtatagatggaaaaagttcgtcatcttcaccgatagcagccctaatggcagattcagaatgatgtggacccccgagagcgacgatagcgcugcuctcgaagtcctcccccctgaactggagagacaagtggaaattctgaccagaagcttccctgcccaccatcccattaatctggccgattgggaactgaccgaaagccccgaaaatggcttcagctttgggaccagccacagctgtgggcatattgtgcaaaatcctaatgtcttcgatgggaaatgttggctgacatgtttcctggggcagagcgccgaggtctgttatcatgaagagcacctggccaatgctctgggctatcagacaaaatggggggtccacggcaaatatctgcagagaagactgcaggtgagagggatgagagccgtcgtggaccccgatgggcccatccatgtggaggccctcagctgtagccaaagctgggtgagacatctcaccctcaacaacgacgtgacacccggctttgtgagactcaccagcattagaatcgtcagcaataccgagcctacagcctttagaattttcagattcggcgcccacaaatggtacggg

SEQ ID NO: 36 - protein, 156 aa, Porcine reproductive and respiratory syndrome virus
SDVYRWKKFVIFTDSSPNGRFRMMWTPESDDSAALEVLPPELERQVEILTRSFPAHHPINLADWELTESPENGFSFGTSHSCGHIVQNPNVFDGKCWLTCFLGQSAEVCYHEEHLANALGYQTKWGVHGKYLQRRLQVRGMRAVVDPDGPIHVEAL

SEQ ID NO: 37 - RNA, 48 nt, Porcine reproductive and respiratory syndrome virus; identical to SEQ ID NO: 30

SEQ ID NO: 38 - RNA, 50 nt, Porcine reproductive and respiratory syndrome virus
acauggguguucuugaaguuuacucccaucucccagcuuuuauacucaca

SEQ ID NO: 39 - RNA, 12 nt, Porcine reproductive and respiratory syndrome virus
uuggcucuugag

SEQ ID NO: 40 - RNA, 48 nt, Porcine reproductive and respiratory syndrome virus
acauggguauucgaaguuuauagucauuugccagcuuuuauacugaca

SEQ ID NO: 41 - RNA, 48 nt, Porcine reproductive and respiratory syndrome virus
acauggguauucgaaguuuacucccaucucccagcuuuuauacucaca

SEQ ID NO: 42 - RNA, 48 nt, Porcine reproductive and respiratory syndrome virus
acauggguuuuugaaguuuauagucauuugccagcuuuuauacucaca

SEQ ID NO: 43 - RNA, 48 nt, Porcine reproductive and respiratory syndrome virus
acauggguuuuugaaguuuacagaaauauggcagcuuuuauacucaca

SEQ ID NO: 44 - RNA, 12 nt, Porcine Respiratory and Reproductive Virus Syndrome
uuggcucuugag

SEQ ID NO: 45 - protein, 883 aa, Porcine reproductive and respiratory syndrome virus
AAGKRARAKRATKSGKDSALAPKIAPPVPTCGITTYSPPTDGSCGWHVLAAIVNRMINGDFTSPLPQYNRPEDDWASDYDLAQAIQCLQLPATVVRNRACPNAKYLIKLNGVHWEVEVRSGMAPRSLSRECVVGVCSEGCVAPPYPADGLPKRALEALASAYRLPSDCVSSGIADFLADPPPQEFWTLDKMLTSPSPERSGFSSLYKLLLEVVPQKCGATEGAFVYAVERMLKDCPSPEQAMALLAKIKVPSSKAPSVSLDECFPAGVPADFEPAFQERPQSPGAAVALCSPDAKGFEGTASEEAQESGHKAVHAVPLAEGPNNEQVQVVAGEQLELGGCGLAIGSAQSSSDSKRENMHNSREDEPLDLSHPAPAATTTLVGEQTPDNPGSDASALPIAVRGFVPTGPILRHVEHCGTESGDSSSPLDLSFAQTLDQPLDLSLAAWPVKATASDPGWVRGRCEPVFLKPRKAFSDGDSALQFGELSESSSVIEFDQTKDTLVADAPVDLTTSNEALSAVDPSEFVELRRPRHSAQALIDRGGPLADVHAKIKNRVYEQCLQACEPGSRATPATREWLDKMWDRVDMKTWRCTSQFQAGRILASLKFLPDMIQDTPPPVPKKNRASDSAGLKQLVARWDKKLSVTPPPKSAGLVLDQTVPPPTDIQQEDATPSDGLSHASDFSSRVSTSWSWKGLMLSGTRLAGSAGQRLMTWVFLKFTPISQLLYSHFSRRGALWLQAIGCLQVLFYLLSCSVVLTQYSDAFPYWVSSLVLCGVFVWVFLVLGWLLLYFYSRLHPTQSVLLVTTIRRNVMLSFWLLSSANFGNLCAALWLAPQVSYVSSLASYSVGHVISGMLSYVYACLQIWPFLLFMWCPKGVVTSVGESV

SEQ ID NO: 46 - protein, 13 aa, Porcine reproductive and respiratory syndrome virus
ATKSGKDSALAPK

SEQ ID NO: 47 - protein, 17 aa, Porcine reproductive and respiratory syndrome virus
LNGVHWEVEVRSGMAPR

SEQ ID NO: 48 - protein, 11 aa, Porcine reproductive and respiratory syndrome virus
RALEALASAYR

SEQ ID NO: 49 - protein, 26 aa, Porcine reproductive and respiratory syndrome virus
MLTSPSPERSGFSSLYKLLLEVVPQK

SEQ ID NO: 50 - protein, 7 aa, Porcine reproductive and respiratory syndrome virus
IKVPSSK

SEQ ID NO: 51 - protein, 16 aa, Porcine reproductive and respiratory syndrome virus
GFEGTASEEAQESGHK

SEQ ID NO: 52 - protein, 10 aa, Porcine reproductive and respiratory syndrome virus
GFVPTGPILR

SEQ ID NO: 53 - protein, 10 aa, Porcine reproductive and respiratory syndrome virus
ATASDPGWVR

SEQ ID NO: 54 - protein, 28 aa, Porcine reproductive and respiratory syndrome virus
KAFSDGDSALQFGELSESSSVIEFDQTK

SEQ ID NO: 55 - protein, 19 aa, Porcine reproductive and respiratory syndrome virus
HSAQALIDRGGPLADVHAK

SEQ ID NO: 56 - protein, 19 aa, Porcine reproductive and respiratory syndrome virus
ATPATREWLDKMWDRVDMK

SEQ ID NO: 57 - protein, 37 aa, Porcine reproductive and respiratory syndrome virus
ILASLKFLPDMIQDTPPPVPKKNRASDSAGLKQLVAR

SEQ ID NO: 58 - protein, 9 aa, Porcine reproductive and respiratory syndrome virus
KLSVTPPPK

SEQ ID NO: 59 - protein, 46 aa, Porcine reproductive and respiratory syndrome virus
VSTSWSWKGLMLSGTRLAGSAGQRLMTWVFLKFTPISQLLYSHFSR

SEQ ID NO: 60 - protein, 14 aa, Porcine reproductive and respiratory syndrome virus
LHPTQSVLLVTTIR

SEQ ID NO: 61 - protein, 169 aa, Porcine reproductive and respiratory syndrome virus
LKFTPISQLLYSHFSRRGALWLQAIGCLQVLFYLLSCSVVLTQYSDAFPYWVSSLVLCGVFVWVFLVLGWLLLYFYSRLHPTQSVLLVTTIRRNVMLSFWLLSSANFGNLCAALWLAPQVSYVSSLASYSVGHVISGMLSYVYACLQIWPFLLFMWCPKGVVTSVGESV

SEQ ID NO: 62 - protein, 714 aa, Porcine reproductive and respiratory syndrome virus
AAGKRARAKRATKSGKDSALAPKIAPPVPTCGITTYSPPTDGSCGWHVLAAIVNRMINGDFTSPLPQYNRPEDDWASDYDLAQAIQCLQLPATVVRNRACPNAKYLIKLNGVHWEVEVRSGMAPRSLSRECVVGVCSEGCVAPPYPADGLPKRALEALASAYRLPSDCVSSGIADFLADPPPQEFWTLDKMLTSPSPERSGFSSLYKLLLEVVPQKCGATEGAFVYAVERMLKDCPSPEQAMALLAKIKVPSSKAPSVSLDECFPAGVPADFEPAFQERPQSPGAAVALCSPDAKGFEGTASEEAQESGHKAVHAVPLAEGPNNEQVQVVAGEQLELGGCGLAIGSAQSSSDSKRENMHNSREDEPLDLSHPAPAATTTLVGEQTPDNPGSDASALPIAVRGFVPTGPILRHVEHCGTESGDSSSPLDLSFAQTLDQPLDLSLAAWPVKATASDPGWVRGRCEPVFLKPRKAFSDGDSALQFGELSESSSVIEFDQTKDTLVADAPVDLTTSNEALSAVDPSEFVELRRPRHSAQALIDRGGPLADVHAKIKNRVYEQCLQACEPGSRATPATREWLDKMWDRVDMKTWRCTSQFQAGRILASLKFLPDMIQDTPPPVPKKNRASDSAGLKQLVARWDKKLSVTPPPKSAGLVLDQTVPPPTDIQQEDATPSDGLSHASDFSSRVSTSWSWKGLMLSGTRLAGSAGQRLMTWVF

SEQ ID NO: 63 - protein, 14 aa, Porcine reproductive and respiratory syndrome virus
PEDDWASDYDLAQA

SEQ ID NO: 64 - protein, 32 aa, Porcine reproductive and respiratory syndrome virus
QESGHKAVHAVPLAEGPNNEQVQVVAGEQLEL

SEQ ID NO: 65 - protein, 13 aa, Porcine reproductive and respiratory syndrome virus
CPKGVVTSVGESV

SEQ ID NO: 66 - protein, 10 aa, Porcine reproductive and respiratory syndrome virus
GVVTSVGESV

SEQ ID NO: 67 - protein, 8 aa, Porcine reproductive and respiratory syndrome virus
LMTWVFLK

SEQ ID NO: 68 - protein, 6 aa, Porcine reproductive and respiratory syndrome virus
LMTWVF

SEQ ID NO: 69 - protein, 5 aa, Porcine reproductive and respiratory syndrome virus
LKFTP

SEQ ID NO: 70 - protein, 10 aa, Porcine reproductive and respiratory syndrome virus
LMTWVFEVYS

SEQ ID NO: 71 - protein, 8 aa, Porcine reproductive and respiratory syndrome virus
HGFLKFTP

SEQ ID NO: 72 - protein, 5 aa, Porcine reproductive and respiratory syndrome virus
HDMGF

SEQ ID NO: 73 - protein, 8 aa, Porcine reproductive and respiratory syndrome virus
LMTWVFLK

SEQ ID NO: 74 - RNA, 30 nt, Porcine reproductive and respiratory syndrome virus
cucaugacauggguuuuugaaguuuacucc

SEQ ID NO: 75 - RNA, 14 nt, Porcine reproductive and respiratory syndrome virus
uugaaguuuacucc

SEQ ID NO: 76 - protein, 1019 aa, Porcine reproductive and respiratory syndrome virus
AGRRARKARHSAITAVAGRASSAREIQQAKKHEAADANKVEHLKRYSPPAEGNCGWHCISAIANRMVNSKFKTTLPERVRPPDDWATDEDLVNAIQILRLPAALDRNGACASAKYVLKLEGEHWTVTVTPGMSPSLLPLECVQGCCEHKGGLGTPDAVEVFGFDPACLNWLAEVMHLPSSAIPAALAEMSGDSGRSASPVTTVWTVSQFFARHNGGSHPDQVRLGKIISLCQVIEDCCCSQNKTNRVTPEEVAAKIDLYLRGATSLEECLARLEKARPPRVMDTSFDWDVVLPGVEAATQTTELPQVNQCRALVPVVTQKSLDNNSVPLTAFSLANYYYRAQGEEVRHRERLTAVLSKLEGVVREEYGLMPTGPGPRPTLPRGLDELKDQMEEDLLKLANAQTTSEMMAWAVEQVDLKTWVKNYPRWTPPPPPPKVQPRKTKSAKSLLERKPVPAPRRKVGTNCGSPISLGDNIPNSWEDLAVGSPYDPPTPPEPATPSGELVVVSTPQCIFRPATPSSEPALIPASRGAVSRPVTPLSEPIPVPAPRRKFQQVKRLSSAAVTPPYQDEPLNLSASSQTEFEAPSLAPPQSEGVLGVKGQEAEEALSEISDMSGDIKPASVSSSSSLSSVRVTRPKYSAQAIIDLGGPCSGHLQEVKEACLGIMREACDATKLDDPATQEWLSRMWDRVDMLTWRNTSAYQAFRTLDGRLKFLPKMILETPPPYPCEFVMMPHSPAPSVGAESDLTIGSVATEDVPRILEKIENVGEMTNQGPLAFSEDKPVDDQLAKDPRISSQSPDESTSAPPTGTGGAGSFTDLPPSDGADADGGGPFRTIKRKAEGLFDRLSRQVFLTSSPISLFSSHAFSTRAVVILRVIGVLQLLLYCASFYATVIQHLVLLPSWVCFLGLLGASEWGFLAAGWLLLLVCSSLCPTQSALLVSLIRQSVETSFILLSFSNLGTLFAALLWAPSVSVLPFLAGYWAGHVASGTFCLGLALLQTVSWLELMCFLKAGVKSAGDLV

SEQ ID NO: 77 - protein, 23 aa, Porcine reproductive and respiratory syndrome virus
ARHSAITAVAGRASSAREIQQAK

SEQ ID NO: 78 - protein, 33 aa, Porcine reproductive and respiratory syndrome virus
YSPPAEGNCGWHCISAIANRMVNSKFKTTLPER

SEQ ID NO: 79 - protein, 15 aa, Porcine reproductive and respiratory syndrome virus
LPAALDRNGACASAK

SEQ ID NO: 80 - protein, 17 aa, Porcine reproductive and respiratory syndrome virus
SASPVTTVWTVSQFFAR

SEQ ID NO: 81 - protein, 49 aa, Porcine reproductive and respiratory syndrome virus
IISLCQVIEDCCCSQNKTNRVTPEEVAAKIDLYLRGATSLEECLARLEK

SEQ ID NO: 82 - protein, 38 aa, Porcine reproductive and respiratory syndrome virus
ALVPVVTQKSLDNNSVPLTAFSLANYYYRAQGEEVRHR

SEQ ID NO: 83 - protein, 46 aa, Porcine reproductive and respiratory syndrome virus
LTAVLSKLEGVVREEYGLMPTGPGPRPTLPRGLDELKDQMEEDLLK

SEQ ID NO: 84 - protein, 9 aa, Porcine reproductive and respiratory syndrome virus
WTPPPPPPK

SEQ ID NO: 85 - protein, 12 aa, Porcine reproductive and respiratory syndrome virus
SLLERKPVPAPR

SEQ ID NO: 86 - protein, 28 aa, Porcine reproductive and respiratory syndrome virus
GAVSRPVTPLSEPIPVPAPRRKFQQVKR

SEQ ID NO: 87 - protein, 5 aa, Porcine reproductive and respiratory syndrome virus
VTRPK

SEQ ID NO: 88 - protein, 27 aa, Porcine reproductive and respiratory syndrome virus
EACLGIMREACDATKLDDPATQEWLSR

SEQ ID NO: 89 - protein, 16 aa, Porcine reproductive and respiratory syndrome virus
NTSAYQAFRTLDGRLK

SEQ ID NO: 90 - protein, 32 aa, Porcine reproductive and respiratory syndrome virus
RKAEGLFDRLSRQVFLTSSPISLFSSHAFSTR

SEQ ID NO: 91 - protein, 20 aa, Porcine reproductive and respiratory syndrome virus
QVFLTSSPISLFSSHAFSTR

SEQ ID NO: 92 - DNA, 15047 bp, Porcine reproductive and respiratory syndrome virus
atgatgtgtagggtatcccccctacatacacaacactttttgtgtttgtgtactttggaggcgtgggtacagccccgccccaccccttggcccctgttctagcccaacaggtatccttctccctcggggcgagtgcgccgcctgctgctcccttgcagtgggaaggacctcccgagtatttccggagagcacctgctttacgggatctccaccctttaaccatgtctgggacgttctcccggtgcatgtgcaccccggctgcccgggtattttggaacgccggccaagtcttttgcacacggtgtctcagtgcgcggcctcttctctctccggaacttcaggacactgacctcggtgtagttggattgttttacaagcctaaggacaagattcactggaaagttcctatcggcattcctcaggtggagtgtactccatccgggtgctgctggctctcagccgtattccctttggcgcgcatgacttccggtaatcacaacttcctccaacgacttgttaaggttgctgatgttttgtatcgcgatggttgcttggcgcctcgacacctccgtgaactccaagtttacgagcgcggttgtagctggtacccaattacggggcccgtacccggaatgggtttgtttgcgaactccatgcacgtgtctgaccagccgttccctggtgccacccatgtgttgactaactcgcctctgcctcagcgggcgtgccggcagccgttctgtccatttgaggaagctcattctgacgtttacaggtggaagaaatttgtgatttttacggactcctctcccaacggtcgatttcgcatgatgtggacgccggaatccgatgactcagccgccctggaggtgctgccgcccgagttagaacgtcaggtcgagatcctcactcggagttttcccgctcatcaccctatcaacctagctgactgggagctcactgagtcccctgagaacggtttttctttcggcacgtcccattcttgcggccacatcgtccagaaccccaacgtgtttgacggcaagtgctggctcacctgctttttgggccaatcggctgaagtgtgctaccacgaggaacatctagctaacgccctcggttaccaaaccaagtggggcgtgcatggtaagtacctccaacgcaggcttcaagtccgcggcatgcgtgctgtggtcgatcctgacggccctattcacgttgaagcgctgtcttgctcccagtcttgggtcaggcacctgactctgaataatgatgtcaccccaggattcgttcgcctgacatccatccgcattgtgtccaacacagaacccaccgctttccggatctttcggtttggagcacataagtggtatggcgctgccggcaaacgggctcgtgccaaacgtgccaccaaaagtgggaaggattcggccctcgctcccaagattgccccaccggtccccacctgtggaatcaccacctactctccaccgacagacgggtcttgtggttggcacgttcttgccgccatagtgaatcggatgataaacggtgactttacgtcccccctgcctcagtacaacagaccagaggatgattgggcttctgattatgatcttgctcaggcgattcaatgtttacaactgcctgccaccgtggttcggaatcgcgcctgtcctaacgccaagtacctcataaagctaaacggggttcactgggaagtagaggtgagatctggaatggctcctcgttccctttctcgtgaatgtgtagttggcgtttgctctgaaggctgtgtcgcaccgccttatccagcggacgggcttcctaaacgtgcactcgaggccttggcgtctgcctacagactaccctcagattgtgttagctctggtattgctgactttcttgctgatccacctcctcaggaattctggactctcgacaaaatgttgacctccccgtcaccggagcggtccggcttctccagcttgtataaattactcttagaggttgttccgcaaaaatgtggtgctacggaaggggctttcgtctatgctgttgagaggatgttaaaggactgtccgagccccgaacaggccatggcccttctggcaaaaattaaagttccatcctcaaaggccccgtctgtgtccttggacgagtgttttcctgcgggtgttccagccgacttcgagccagcatttcaggaaaggccccaaagtcccggtgctgctgtcgccctgtgttcaccggacgcaaaagggttcgagggaacagcctcggaagaagctcaagagagtggccataaggccgtccacgctgtaccccttgccgaaggtcccaataatgaacaggtacaggtggttgctggtgagcagctagagctcggcggttgtggtttggcaatcgggagtgctcagtcctcttcagactccaagagagaaaacatgcacaatagccgggaagacgaaccattggatttgtcccacccagcaccggctgccacgacgacccttgtgggagagcaaacacccgacaacccaggttctgatgccagtgctctccccatcgccgttcgaggatttgtcccgacagggcccatactccgtcatgttgagcactgcggcacagagtcaggcgacagcagttcgcctttggatctgtcttttgcgcaaacgttggaccagcctttagatctatccttggccgcttggccggtgaaggccaccgcgtctgatcctggctgggtccgcggtaggtgcgagcctgtctttttaaagcctcggaaagctttctctgatggcgattcggcccttcagttcggggagctttctgagtccagctctgtcatcgagtttgaccagacaaaagatactctggtggctgacgcccctgttgacttgacgacttcgaacgaggccctctctgcagtcgacccttccgaatttgtcgaactcaggcgcccgcgtcattccgcacaagccttaattgaccgaggcggtccacttgctgatgtccatgcgaaaataaagaaccgggtgtatgaacagtgcctccaagcttgtgagcctggtagtcgtgcaaccccagccaccagggagtggctcgacaaaatgtgggatagggtggacatgaaaacttggcgctgcacttcacagttccaggccggtcgcattcttgcgtccctcaaatttcttcctgacatgattcaagacacgccgcctcctgtccccaagaagaaccgagctagtgacagtgccggtctgaagcaactggtggcacggtgggataagaaattgagtgtaaccccccccccaaaatcggctgggttagtgcttgaccagaccgtccctccgcctacggatatccagcaagaggatgccaccccctccgacgggttatcccatgcatcggatttttctagtcgagtgagcacgagctggagttggaaaggccttatgctttccggcacccgtctcgcggggtctgctggtcagcgcctcatgacatgggtttttgaagtttactcccatctcccagcttttatactcacacttttctcgccgcggggctctatggctccaggcgattggttgtttgcaggtgttgttttacttgctctcttgctctgtcgttcttacccaatactcggatgccttcccttactgggtgtcttctctggttctttgcggcgtgttcgtctgggtgtttttggttcttggatggcttttgctgtatttttattctcgactccatccaacccagtcggttcttcttgtgaccacgattcgccggaatgtcatgctgagcttttagctctagagcagcgccaactttgggaacctgtgcgcggccttgtggttggcccctcaggtctcttatgtgtcatccttggcaagttactcggtgggtcacgtcatctctggcatgttatcctacgtttatgcatgcttacagatttggccctttctcttgtttatgtggtgtcccaagggcgttgtcacaagtgttggggaaagtgtataaggacagctcctgctgaggtggctctcaatgtatttcctttctcgcgcgccactcgcaactctctcacatccttgtgtgatcggttccaaactcctaaaggagttgatcccgtgcacttggcaacgggttggcgcgggtgttggcgtggtgagagtcccatccatcaaccacaccaaaagcccatagcttatgccaatttggatgaaaagaaaatatctgctcaaacggtggttgctgtcccatacgaccccagtcaggctatcaaatgtctgaaggttctgcaggcgggaggggctatcgtggaccagcctacgcctgaagttgttcgtgtgtctgaaatccccttttcagccccatttttcccaaaagttccagtcaacccagattgcaggattgtggtggattcagatacttttgtggctgcagtccgctgcggttactcgacagcacaactggtcctaggccggggcaactttgccaagttgaatcagaccccccttagggactctgcctccaccaaaacgactggtggggcctcttatactcttgctgtggctcaagtgtctgtgtggactcttgttcatttcatcctcggtctttggttcacatcacctcaagtgtgtggccgaggaaccgctgacccatggtgttcaaatcccttttcgtatcctgcctacggccctggagttgtgtgctcctctcgactttgtgtgtctgccgatggggtcaccctgccattgttctcagctgtggcacaactctccggtagagaggtagggatttttattttagtgcttgtttccttgactgccttggcccatcgcctggctcttaaggcagacatgttagtggtcttttcagctttttgtgcttacgcctggcccatgagctcctggttaatctgcttctttcctatactcttaaagtgggttacccttcaccccctcactatgctttgggtgcactcattcttggtgttttgtatgccagcagccggcatcctctcactagggataactggccttctctgggcagttggccgctttacccaggttgccggaattattacaccttatgacatccaccagtatacctctgggccacgcggtgcagccgctgtagccacagccccagaaggcacttatatggccgccgtccggagagctgctttaactggacgaactttgatcttcaccccgtctgcggtcggatcccttcttgaaggtgctttcaggactcataaaccctgccttaacaccgtgaatgttgtgggttcttcccttggttctggaggggtttttaccattgatggcagaaagaccgtcgtcactgctgctcatgtgttgaacggcgacacagctagagttaccggcgactcttacaaccgcatgcacacttttaagaccagtggcgattatgcctggtcccatgctgatgactggcagggcgttgcccctgtggtcaaggttgcgaaggggtatcgcggtcgtgcctactggcaaacatcaaccggtgtcgaacccggcgtcattggggaagggttcgccttctgtttcaccaactgtggcgattcggggtcacccgtcatctcagaatctggtgatctcatcggaatccataccggttcaaacaaactcggttctggtcttgtgacgacccctgaaggggaaacctgcgccatcaaagaaaccaagctctctgacctttccagacattttgcgggcccgagcgtccctcttggggacattaaattgagtccggccatcgtccctgatgtaacatctattccgagtgacttggcatcgctcctagcttccgtccctgtaatggaaggcggcctctcgaccgttcaacttctgtgtgtctttttccttctctggcgcatgatgggccatgcctggacacccattgttgccgtgggcttctttttgctgaatgaaattcttccagcagttttggtccgagccgtgttttcctttgcactctttattcttgcatgggccaccccctggtccgcacaggtgttaatgattagactcctcacggcatccctcaaccgcaacaagttgtctctggcgttctacgcacttgggggtgtcgtcggtttggccgctgaaatcggggcttttgccggcaggctgcctgaattgtctcaagctctttcgacatactgtttcttacctagggtccttgccatggccagttatgttcccatcatcatcattggtggactccatgccctcggtgtgattctgtggttgttcaaataccggtgcctccacaacatgctggttggtgatgggagtttctcaagcgctttcttcctacggtattttgcagagggtaatcttagaaaaggtgtttcacagtcttgtggcatgagtaacgagtccctgacggctgctctagcttgcaagttgtcgcaggctgaccttgactttttgtccagcttaacgaacttcaagtgctttgtatctgcttcaaacatgaaaaatgctgccggccagtatattgaagcagcgtatgccaaggccctgcgccaagagttggcctccctagttcaggttgacaaaatgaaaggaattttgtctaagcttgaggcctttgctgaaacagccactccgtcccttgacgcaggtgacgtggttgttctgcttgggcaacatcctcacggatccatcctcgatattaatgtggggactgaaaggaaaactgtgtccgtgcaagagacccggagcttaggtggttccaaattcagtgtttgcactgtcgtgtccaacacacccgtggacgccttaactggcatcccactccagacaccaacccctctttttgagaatggtccgcgtcaccgtggtgaggaagacgatcttagagtcgagaggatgaagaaacactgtgtgtccctcggcttccacaacattaatggcaaagtttactgcaaaatttgggacaagtccaccggtgataccttttataccgatgattcccggtacacccaagaccttgcattccaggacaggtcagccgactacagagacagggattatgagggtgtgcaaaccgccccccaacagggctttgatccaaagtctgaaacccctattggcactgtggtgatcggcggtatcacgtataacaggtacctgatcaaaggtaaggaggtcttggttcccaagcctgacaactgccttgaagctgccaagctgtcccttgagcaagctctcgctgggatgggccaaacttgcgaccttacagctgccgaggtggaaaagttgaggcgcatcattagccagctccaaggtttgaccactgaacaggctttaaactgttagccgccagcggcttgacccgctgtggccgcggcggcttagttgtaactgaaacagcggtaaaaatcgtaaagtaccacagcagaactttcaccctaggccctctggacctgaaagtcacctccgaggctgaggtaaagaaatcaactgagcagggccacgctgttgtggcaaacttatgttctggtgtcatcttgatgagacctcacccaccgtcccttgttgatgttcttctgaaacccggacttgacacaaaacccggcattcaaccagggcatggggccgggaatatgggcgtagacggctctacttgggattttgaaaccgcacccacaaaggcagaacttgagttgtccaaacaaataattcaagcatgtgaagttaggcgcggggacgccccgaacctccaactcccttacaagctctatcctgttagaggggatcctgagcggcatgggggccgccttatcaataccaggtttggagatctatcttacaaaacccctcaagacaccaagtccgcaatccatgcggcttgttgcctgcaccccaacggggcccctgtgtctgatggtaagtcaacactaggtaccacccttcaacatggtttcgaactttatgtccccactgtgccctatagtgtcatggagtacctcgattcacgccctgacacccctttcatgtgcactaaacatggtacttccaaggctgctgcagaagacctccaaaaatacgacctatctactcaaggatttgtcctgcccggggtcttacgccttgtacgcagattcatctttggccatattggtaaggcaccgccattgttcctcccgtcaacctatcccgctaaaaattctatggcagggatcaatggccagaggttcccaacaaaggacgtccagagcatacctgaaattgacgaaatgtgtgcccgcgccgtcaaggagaattggcaaactgtgacaccttgtaccctcaagaaacagtactgttccaagcccaaaaccaggaccatcctgggcaccaacaactttattgccctggctcaccgatcggcgctcagtggtgtcacccaggcattcatgaagaaggcttggaagtccccgattgccttgggaaaaaacaaattcaaggagctgcattgcactgtcgccggcaggtgtcttgaagccgacttggcctcctgtgaccgcagcacccccgccattgtgaggtggttcgtcgccaacctcctgtatgaacttgcaggatgtgaagagtacttgcctagctatgtgcttaactgctgccatgaccttgtggcaacacaggatggtgccttcacaaaacgcggtggcctgtcgtccggggaccccgtcaccagtgtgtctaacaccgtatattcactgataatctatgcccagcacatggtgttgtcggccttaaaaatgggtcatgaaatcggtctcaagttcctcgaggaacagctcaaattcgaggacctcctcgaaatccagcctatgttggtctattctgatgaccttgtcttgtacgctgaaaggcccacttttcctaattatcactggtgggtcgagcaccttgacctaatgctgggtttcagaacggacccaaagaagacagtcataactgataaacccagcttcctcggctgcagaattgaggcggggcgacagctggtccctaatcgcgaccgcatcctggctgctctcgcatatcacatgaaggcgcagaacgcctcagagtattatgcgtctgctgccgcaatcctgatggattcatgtgcttgcattgatcatgaccctgagtggtatgaggacctcatctgcggtatcgcccgatgcgcccgccaggatggttatagtttcccaggcccggcatttttcatgtccatgtgggaaaagctgagaagtcacaatgaagggaagaaatttcgacactgcggcatctgcgacgccaaagccgaccatgcatccgcctgtgggcttgatttgtgtttgttccactcacactttcatcaacactgccccgtcactctgagctgtggtcatcatgccggttcaagggaatgttcgcagtgtcagtcacctgttggggctggcagatctcctcttgatgccgtgctaaaacaaatcctgtacaaacctcctcgtacagtcatcatgaaggtgggtaacaaaacaacggccctcgatccggggaggtaccagtcccgtcgaggtcttgttgcagtcaagaggggtattgcaggcaatgaagttgatcttcctgatggggactaccaagtagtgcctcttttaccaacttgtaaagacataaacatggtaaaggtggcttgcaatgtactactcagtaagttcatagtggggccaccaggttccggaaagaccacctggttactgagtcaagtccaggacgatgatgtcatttacacacccacccatcagaccatgtttgatatagtcagtgctctcaaagtttgcaggtattctattccaggagcctcaggacttcctttcccaccacctgccaggtccgggccgtgggttaggctcgtggccagcgggcacgtccccggccgaacatcatacctcgatgaggctggatattgtaatcatctggacattctcagactgctttccaaaacacccctcgtgtgtttgggtgaccttcaacaacttcaccctgtcggctttgactcctactgttatgtgtttgatcagatgcctcaaaagcaactgaccactatttatagatttggccctaacatctgcgcagccatccagccttgttacagggagaagcttgaatctaaggctaggaacaccagggtggtctttaccacctggcctgtggcctttggtcaggtgctgacaccataccataaagatcgcatcggctctgcgataaccatagactcatcccagggggccactttcgacattgtgacattgcatctaccatcaccaaagtccctaaataaatcccgagcacttgtagccatcactcgggcaagacacgggttgttcatttatgaccctcacaaccagctccaggagtttttcaacctgatccctgagcgcactgattgcaaccttgtgttcagccgtggggatgatctggtagttcttagtgcggacaatgcagtcacaactgtagcgaaggccctagggacaggtccatctcgatttcgagtatcagacccgaggtgcaagtctctcttagctgcttgttcggccagtctggaggggagctgtatgccactaccacaagtggcacataacctggggttttacttctccccagacagtccagcatttgcacctctgccaaaggagttagcgccacattggccagtggttactcaccagaacaatcgggcgtggcccgatcgacttgtcgctagtatgcgcccaattgatgcccgctacagcaagccaatggtcggtgcagggtatgtggtcgggccgtccacctttcttggtactcctggtgtagtgtcatactacctcacgctatacatcaggggtgagccccaggccttgccagagacactcgtttcaacaggacgcatagccactgactgccgggagtatctcgacgcggctgaggaagaggcagcaaaagaactcccccacgcattcattggcgatgtcaaaggtaccacggtcggggggtgtcaccacatcacatcaaaatacctacccaggaccctgcctaaggactctgttgctgtagttggagtaagctcgcccggcagggctgctaaagccatgtgcactctcactgatgtgtatctccccgaactccggccatacctgcaacctgagacggcgtcgaaatgctggaaactcaaattagacttcagggacgtccgactaatggtctggaaaggagccaccgcccatttccagttggaaggacttacatggtcagcgctgcctgactatgccaggtttattcagcttcccaaggacgccgttgtgtacattgatccgtgtataggaccggcaacagccaaccgcaaggtcgtgcgaaccacagactggcgggccgacctggcagtgacaccgtatgattacggtgcccagaacattttgacaacagcctggttcgaggacctcgggccgcagtggaagattttggggttgcagcccttcaggcgggcatttggctttgaaaatactgaggattgggcaatccttgcacgccgtatgagtgacggcaaagactacactgactacaactgggattgtgttcgagaacgcccacacgccatctacgggcgtgctcgtgaccatacatatcattttgcccccggcacggaattgcaggtagagctgggtaaaccccggctgccgcctggacgagagccgtaaacttggagtgatgcaatggggtcactgtggagtaaaatcagccagctgttcgtggatgccttcactgagtttcttgtcagtgtggttgatattgtcattttccttgccatactgtttgggttcaccgtcgcaggatggttattggtctttcttctcagagtggtttgctccgcgcttctccgttcgcgctctgccattcactctcccgaactatcgaaggtcctatgaaagcttgttgcccaactgcaggccggatgtcccacaatttgcatttaagcacccattgggtatactttggcacatgcgagtttcccacctgattgatgagatggtctctcgccgcatttaccagaccatggaacattcaggtcaagcggcctggaaatatgtggtcggtgaggccactctcacgaagctatcaaagcttgatatagttactcatttccaacatctggccgcagtagaggcggattcttgccgctttctcagctcacgactcgtgatgctaaaaaatcttgccgttggcaatgtgagcctacagtacaacaccacgttggatcgcgttgaactcattttccccacgccaggtacgaggcccaagttgaccgacttcagacaatggctcatcagtgtgcatgcttccattttttcctctgtggcttcatctgttaccttgttcatagtgctttggctgcgaattccagctctacgctatgtttttggtttccattggcccacggcaacacatcattcgagctgaccatcaattataccatatgcatgccctgtcttaccagtcaagcagctcgccaaaggctcgagcccggtcgtaacatgtggtgcagaatagggcatgataggtgtgaggagcgtgaccatgatgagttgttaatgtccatcccgtccgggtacgacaacctcaaacttgagggatattatgcttggctggcttttttgtccttttcctacgcggcccaattccatccggagctgttcgggatagggaatgtgtcgcgcgtcttcgtggacaagcgacaccagtttatttgtgccgagcatggtggactcaattcaaccttatctaccgagcacaatatctccgcattatatgcggtatattatcaccaccaaatagacgggggtaattggttccatttggaatggctgcggccgcttttttcctcctggttggtgctcaacatatcatggtttctgaggcgttcgcctgtaagccctgtttctcgacgcatctatcagatattaagaccaacacgaccgcggctgccggtttcatggtccttcagaacatcaattgttcccggcctcacgaggcctcagcaacgcaaggtcaagttccctccagaaagtcgtcccaatgccgtgaagccgtcggtgttccccaatacatcacgataacggccaacgtgaccgacgaatcatatttgtacaacgcggacttgctgatgctttctgcgtgccttttctacgcctcggaaatgagcgagaaaggctttaaagttatctttgggaatgtctctggcgttgtttctgcttgtgtcaatttcacagattatgtggcccatgtgacccaacatacccagcagcatcatctggtgattaatcacatccggttactgcacttcctgacaccatctgcaatgaggtgggctacaaccattgcttgtctgttcgccattctcttggcgatatgaaatgttctcacaaattggggcattccttgactccgcactcttgcttctggtggctttttttgctgtgtaccggcttgtcctggtcctttgccgatggcaacggcaacaactcgacataccaatacatatataatttgacgatatgcgagttgaatgggaccaattggctgtccggccattttgaatgggcagttgagacctttgtgctttacccggttgtcactcatatcctctcactgggttttctcacgacaagtcatttttttgacgcgctcggtctcggcgctgtatccactgcaggatttgtcggagggcggtatgtacttagcagcgtctacggcgcttgtgctttcgcagcgttcgtatgcttcgtcatccgtgctgctaaaaattgcatggcctgccgctatgcccgtacccggttcaccaacttcattgtggacgaccgggggggagttcatagatggaagtctccaatagtggtagaaaaactgggcaaagccgaaattggcggcaaccttgtcaccatcaaacatgtcgtcctcgaaggggttaaagctcaacccttgacgagaacttcggccgagcaatgggaggcctagataatttttgcaacgatcctaccgccgcacaaaagatcgtgctagccttcagcatcacatacacacctataatgatatacgcccttaaggtgtcacgcggccgactcctggggctgttgcacatcctaatatttctgaactgttcctttacattcggatacatgacatatgtgcattttcattctacccaccgtgtcgcacttaccctgggggctgttgtcgcccttttgtggggtgtctacagcctcacagagtcatggaagtttatcacttccagatgcagattgtgttgcctcggccggcgatacattctggcccctgcccatcacgtagaaagtgctgcaggtctccattcaatctcagcgtctggtaaccgagcatacgctgtgagaaagcccggactaacatcagtgaacggcactctagtaccaggacttcggagcctcgtgctgggcggcaaacgagctgttaaacgaggagtggttaacctcgtcaagtatggccggtaaaaatcagagccagaagaaaaagaaaagtacggctccaatggggaatggccagccagtcaatcaactgtgccagttgctgggtgcaatgataaagtcccagcgccagcaacctaggggaggacaggctaaaaagaaaaagcctgagaagccacattttcccctggctgcagaagatgacatccggcaccacctcacccaaactgaacgctccctctgcttgcaatcgatccagacggctttcaatcaaggcgcaggaactgcgtcgctttcatccagcgggaaggtcagtttccaggttgagtttatgctgccggttgctcatacagtgcgcctgattcgcgtgacttctacatccgccagtcagggtgcaaattaatttgacagtcaggtgaatggccgcgattggcgtgtggcctctgagtcacctattcaattagggcgatcacatgggggtcatacttaatcaggcaggaaccatgtgaccgaaatt

SEQ ID NO: 93 - DNA, 15047 bp, Porcine reproductive and respiratory syndrome virus
atgatgtgtagggtatcccccctacatacacaacactttttgtgtttgtgtactttggaggcgtgggtacagccccgccccaccccttggcccctgttctagcccaacaggtatccttctccctcggggcgagtgcgccgcctgctgctcccttgcagtgggaaggacctcccgagtatttccggagagcacctgctttacgggatctccaccctttaaccatgtctgggacgttctcccggtgcatgtgcaccccggctgcccgggtattttggaacgccggccaagtcttttgcacacggtgtctcagtgcgcggcctcttctctctccggaacttcaggacactgacctcggtgtagttggattgttttacaagcctaaggacaagattcactggaaagttcctatcggcattcctcaggtggagtgtactccatccgggtgctgctggctctcagccgtattccctttggcgcgcatgacttccggtaatcacaacttcctccaacgacttgttaaggttgctgatgttttgtatcgcgatggttgcttggcgcctcgacacctccgtgaactccaagtttacgagcgcggttgtagctggtacccaattacggggcccgtacccggaatgggtttgtttgcgaactccatgcacgtgtctgaccagccgttccctggtgccacccatgtgttgactaactcgcctctgcctcagcgggcgtgccggcagccgttctgtccatttgaggaagctcattctgacgtttacaggtggaagaaatttgtgatttttacggactcctctcccaacggtcgatttcgcatgatgtggacgccggaatccgatgactcagccgccctggaggtgctgccgcccgagttagaacgtcaggtcgagatcctcactcggagttttcccgctcatcaccctatcaacctagctgactgggagctcactgagtcccctgagaacggtttttctttcggcacgtcccattcttgcggccacatcgtccagaaccccaacgtgtttgacggcaagtgctggctcacctgctttttgggccaatcggctgaagtgtgctaccacgaggaacatctagctaacgccctcggttaccaaaccaagtggggcgtgcatggtaagtacctccaacgcaggcttcaagtccgcggcatgcgtgctgtggtcgatcctgacggccctattcacgttgaagcgctgtcttgctcccagtcttgggtcaggcacctgactctgaataatgatgtcaccccaggattcgttcgcctgacatccatccgcattgtgtccaacacagaacccaccgctttccggatctttcggtttggagcacataagtggtatggcgctgccggcaaacgggctcgtgccaaacgtgccaccaaaagtgggaaggattcggccctcgctcccaagattgccccaccggtccccacctgtggaatcaccacctactctccaccgacagacgggtcttgtggttggcacgttcttgccgccatagtgaatcggatgataaacggtgactttacgtcccccctgcctcagtacaacagaccagaggatgattgggcttctgattatgatcttgctcaggcgattcaatgtttacaactgcctgccaccgtggttcggaatcgcgcctgtcctaacgccaagtacctcataaagctaaacggggttcactgggaagtagaggtgagatctggaatggctcctcgttccctttctcgtgaatgtgtagttggcgtttgctctgaaggctgtgtcgcaccgccttatccagcggacgggcttcctaaacgtgcactcgaggccttggcgtctgcctacagactaccctcagattgtgttagctctggtattgctgactttcttgctgatccacctcctcaggaattctggactctcgacaaaatgttgacctccccgtcaccggagcggtccggcttctccagcttgtataaattactcttagaggttgttccgcaaaaatgtggtgctacggaaggggctttcgtctatgctgttgagaggatgttaaaggactgtccgagccccgaacaggccatggcccttctggcaaaaattaaagttccatcctcaaaggccccgtctgtgtccttggacgagtgttttcctgcgggtgttccagccgacttcgagccagcatttcaggaaaggccccaaagtcccggtgctgctgtcgccctgtgttcaccggacgcaaaagggttcgagggaacagcctcggaagaagctcaagagagtggccataaggccgtccacgctgtaccccttgccgaaggtcccaataatgaacaggtacaggtggttgctggtgagcagctagagctcggcggttgtggtttggcaatcgggagtgctcagtcctcttcagactccaagagagaaaacatgcacaatagccgggaagacgaaccattggatttgtcccacccagcaccggctgccacgacgacccttgtgggagagcaaacacccgacaacccaggttctgatgccagtgctctccccatcgccgttcgaggatttgtcccgacagggcccatactccgtcatgttgagcactgcggcacagagtcaggcgacagcagttcgcctttggatctgtcttttgcgcaaacgttggaccagcctttagatctatccttggccgcttggccggtgaaggccaccgcgtctgatcctggctgggtccgcggtaggtgcgagcctgtctttttaaagcctcggaaagctttctctgatggcgattcggcccttcagttcggggagctttctgagtccagctctgtcatcgagtttgaccagacaaaagatactctggtggctgacgcccctgttgacttgacgacttcgaacgaggccctctctgcagtcgacccttccgaatttgtcgaactcaggcgcccgcgtcattccgcacaagccttaattgaccgaggcggtccacttgctgatgtccatgcgaaaataaagaaccgggtgtatgaacagtgcctccaagcttgtgagcctggtagtcgtgcaaccccagccaccagggagtggctcgacaaaatgtgggatagggtggacatgaaaacttggcgctgcacttcacagttccaggccggtcgcattcttgcgtccctcaaatttcttcctgacatgattcaagacacgccgcctcctgtccccaagaagaaccgagctagtgacagtgccggtctgaagcaactggtggcacggtgggataagaaattgagtgtaaccccccccccaaaatcggctgggttagtgcttgaccagaccgtccctccgcctacggatatccagcaagaggatgccaccccctccgacgggttatcccatgcatcggatttttctagtcgagtgagcacgagctggagttggaaaggccttatgctttccggcacccgtctcgcggggtctgctggtcagcgcctcatgacatggguauucgaaguuuauagucauuugccagcuuuuauacugacacuuttctcgccgcggggctctatggctccaggcgattggttgtttgcaggtgttgttttacttgctctcttgctctgtcgttcttacccaatactcggatgccttcccttactgggtgtcttctctggttctttgcggcgtgttcgtctgggtgtttttggttcttggatggcttttgctgtatttttattctcgactccatccaacccagtcggttcttcttgtgaccacgattcgccggaatgtcatgctgagcttttggctcttgagcagcgccaactttgggaacctgtgcgcggccttgtggttggcccctcaggtctcttatgtgtcatccttggcaagttactcggtgggtcacgtcatctctggcatgttatcctacgtttatgcatgcttacagatttggccctttctcttgtttatgtggtgtcccaagggcgttgtcacaagtgttggggaaagtgtataaggacagctcctgctgaggtggctctcaatgtatttcctttctcgcgcgccactcgcaactctctcacatccttgtgtgatcggttccaaactcctaaaggagttgatcccgtgcacttggcaacgggttggcgcgggtgttggcgtggtgagagtcccatccatcaaccacaccaaaagcccatagcttatgccaatttggatgaaaagaaaatatctgctcaaacggtggttgctgtcccatacgaccccagtcaggctatcaaatgtctgaaggttctgcaggcgggaggggctatcgtggaccagcctacgcctgaagttgttcgtgtgtctgaaatccccttttcagccccatttttcccaaaagttccagtcaacccagattgcaggattgtggtggattcagatacttttgtggctgcagtccgctgcggttactcgacagcacaactggtcctaggccggggcaactttgccaagttgaatcagaccccccttagggactctgcctccaccaaaacgactggtggggcctcttatactcttgctgtggctcaagtgtctgtgtggactcttgttcatttcatcctcggtctttggttcacatcacctcaagtgtgtggccgaggaaccgctgacccatggtgttcaaatcccttttcgtatcctgcctacggccctggagttgtgtgctcctctcgactttgtgtgtctgccgatggggtcaccctgccattgttctcagctgtggcacaactctccggtagagaggtagggatttttattttagtgcttgtttccttgactgccttggcccatcgcctggctcttaaggcagacatgttagtggtcttttcagctttttgtgcttacgcctggcccatgagctcctggttaatctgcttctttcctatactcttaaagtgggttacccttcaccccctcactatgctttgggtgcactcattcttggtgttttgtatgccagcagccggcatcctctcactagggataactggccttctctgggcagttggccgctttacccaggttgccggaattattacaccttatgacatccaccagtatacctctgggccacgcggtgcagccgctgtagccacagccccagaaggcacttatatggccgccgtccggagagctgctttaactggacgaactttgatcttcaccccgtctgcggtcggatcccttcttgaaggtgctttcaggactcataaaccctgccttaacaccgtgaatgttgtgggttcttcccttggttctggaggggtttttaccattgatggcagaaagaccgtcgtcactgctgctcatgtgttgaacggcgacacagctagagttaccggcgactcttacaaccgcatgcacacttttaagaccagtggcgattatgcctggtcccatgctgatgactggcagggcgttgcccctgtggtcaaggttgcgaaggggtatcgcggtcgtgcctactggcaaacatcaaccggtgtcgaacccggcgtcattggggaagggttcgccttctgtttcaccaactgtggcgattcggggtcacccgtcatctcagaatctggtgatctcatcggaatccataccggttcaaacaaactcggttctggtcttgtgacgacccctgaaggggaaacctgcgccatcaaagaaaccaagctctctgacctttccagacattttgcgggcccgagcgtccctcttggggacattaaattgagtccggccatcgtccctgatgtaacatctattccgagtgacttggcatcgctcctagcttccgtccctgtaatggaaggcggcctctcgaccgttcaacttctgtgtgtctttttccttctctggcgcatgatgggccatgcctggacacccattgttgccgtgggcttctttttgctgaatgaaattcttccagcagttttggtccgagccgtgttttcctttgcactctttattcttgcatgggccaccccctggtccgcacaggtgttaatgattagactcctcacggcatccctcaaccgcaacaagttgtctctggcgttctacgcacttgggggtgtcgtcggtttggccgctgaaatcggggcttttgccggcaggctgcctgaattgtctcaagctctttcgacatactgtttcttacctagggtccttgccatggccagttatgttcccatcatcatcattggtggactccatgccctcggtgtgattctgtggttgttcaaataccggtgcctccacaacatgctggttggtgatgggagtttctcaagcgctttcttcctacggtattttgcagagggtaatcttagaaaaggtgtttcacagtcttgtggcatgagtaacgagtccctgacggctgctctagcttgcaagttgtcgcaggctgaccttgactttttgtccagcttaacgaacttcaagtgctttgtatctgcttcaaacatgaaaaatgctgccggccagtatattgaagcagcgtatgccaaggccctgcgccaagagttggcctccctagttcaggttgacaaaatgaaaggaattttgtctaagcttgaggcctttgctgaaacagccactccgtcccttgacgcaggtgacgtggttgttctgcttgggcaacatcctcacggatccatcctcgatattaatgtggggactgaaaggaaaactgtgtccgtgcaagagacccggagcttaggtggttccaaattcagtgtttgcactgtcgtgtccaacacacccgtggacgccttaactggcatcccactccagacaccaacccctctttttgagaatggtccgcgtcaccgtggtgaggaagacgatcttagagtcgagaggatgaagaaacactgtgtgtccctcggcttccacaacattaatggcaaagtttactgcaaaatttgggacaagtccaccggtgataccttttataccgatgattcccggtacacccaagaccttgcattccaggacaggtcagccgactacagagacagggattatgagggtgtgcaaaccgccccccaacagggctttgatccaaagtctgaaacccctattggcactgtggtgatcggcggtatcacgtataacaggtacctgatcaaaggtaaggaggtcttggttcccaagcctgacaactgccttgaagctgccaagctgtcccttgagcaagctctcgctgggatgggccaaacttgcgaccttacagctgccgaggtggaaaagttgaggcgcatcattagccagctccaaggtttgaccactgaacaggctttaaactgttagccgccagcggcttgacccgctgtggccgcggcggcttagttgtaactgaaacagcggtaaaaatcgtaaagtaccacagcagaactttcaccctaggccctctggacctgaaagtcacctccgaggctgaggtaaagaaatcaactgagcagggccacgctgttgtggcaaacttatgttctggtgtcatcttgatgagacctcacccaccgtcccttgttgatgttcttctgaaacccggacttgacacaaaacccggcattcaaccagggcatggggccgggaatatgggcgtagacggctctacttgggattttgaaaccgcacccacaaaggcagaacttgagttgtccaaacaaataattcaagcatgtgaagttaggcgcggggacgccccgaacctccaactcccttacaagctctatcctgttagaggggatcctgagcggcatgggggccgccttatcaataccaggtttggagatctatcttacaaaacccctcaagacaccaagtccgcaatccatgcggcttgttgcctgcaccccaacggggcccctgtgtctgatggtaagtcaacactaggtaccacccttcaacatggtttcgaactttatgtccccactgtgccctatagtgtcatggagtacctcgattcacgccctgacacccctttcatgtgcactaaacatggtacttccaaggctgctgcagaagacctccaaaaatacgacctatctactcaaggatttgtcctgcccggggtcttacgccttgtacgcagattcatctttggccatattggtaaggcaccgccattgttcctcccgtcaacctatcccgctaaaaattctatggcagggatcaatggccagaggttcccaacaaaggacgtccagagcatacctgaaattgacgaaatgtgtgcccgcgccgtcaaggagaattggcaaactgtgacaccttgtaccctcaagaaacagtactgttccaagcccaaaaccaggaccatcctgggcaccaacaactttattgccctggctcaccgatcggcgctcagtggtgtcacccaggcattcatgaagaaggcttggaagtccccgattgccttgggaaaaaacaaattcaaggagctgcattgcactgtcgccggcaggtgtcttgaagccgacttggcctcctgtgaccgcagcacccccgccattgtgaggtggttcgtcgccaacctcctgtatgaacttgcaggatgtgaagagtacttgcctagctatgtgcttaactgctgccatgaccttgtggcaacacaggatggtgccttcacaaaacgcggtggcctgtcgtccggggaccccgtcaccagtgtgtctaacaccgtatattcactgataatctatgcccagcacatggtgttgtcggccttaaaaatgggtcatgaaatcggtctcaagttcctcgaggaacagctcaaattcgaggacctcctcgaaatccagcctatgttggtctattctgatgaccttgtcttgtacgctgaaaggcccacttttcctaattatcactggtgggtcgagcaccttgacctaatgctgggtttcagaacggacccaaagaagacagtcataactgataaacccagcttcctcggctgcagaattgaggcggggcgacagctggtccctaatcgcgaccgcatcctggctgctctcgcatatcacatgaaggcgcagaacgcctcagagtattatgcgtctgctgccgcaatcctgatggattcatgtgcttgcattgatcatgaccctgagtggtatgaggacctcatctgcggtatcgcccgatgcgcccgccaggatggttatagtttcccaggcccggcatttttcatgtccatgtgggaaaagctgagaagtcacaatgaagggaagaaatttcgacactgcggcatctgcgacgccaaagccgaccatgcatccgcctgtgggcttgatttgtgtttgttccactcacactttcatcaacactgccccgtcactctgagctgtggtcatcatgccggttcaagggaatgttcgcagtgtcagtcacctgttggggctggcagatctcctcttgatgccgtgctaaaacaaatcctgtacaaacctcctcgtacagtcatcatgaaggtgggtaacaaaacaacggccctcgatccggggaggtaccagtcccgtcgaggtcttgttgcagtcaagaggggtattgcaggcaatgaagttgatcttcctgatggggactaccaagtagtgcctcttttaccaacttgtaaagacataaacatggtaaaggtggcttgcaatgtactactcagtaagttcatagtggggccaccaggttccggaaagaccacctggttactgagtcaagtccaggacgatgatgtcatttacacacccacccatcagaccatgtttgatatagtcagtgctctcaaagtttgcaggtattctattccaggagcctcaggacttcctttcccaccacctgccaggtccgggccgtgggttaggctcgtggccagcgggcacgtccccggccgaacatcatacctcgatgaggctggatattgtaatcatctggacattctcagactgctttccaaaacacccctcgtgtgtttgggtgaccttcaacaacttcaccctgtcggctttgactcctactgttatgtgtttgatcagatgcctcaaaagcaactgaccactatttatagatttggccctaacatctgcgcagccatccagccttgttacagggagaagcttgaatctaaggctaggaacaccagggtggtctttaccacctggcctgtggcctttggtcaggtgctgacaccataccataaagatcgcatcggctctgcgataaccatagactcatcccagggggccactttcgacattgtgacattgcatctaccatcaccaaagtccctaaataaatcccgagcacttgtagccatcactcgggcaagacacgggttgttcatttatgaccctcacaaccagctccaggagtttttcaacctgatccctgagcgcactgattgcaaccttgtgttcagccgtggggatgatctggtagttcttagtgcggacaatgcagtcacaactgtagcgaaggccctagggacaggtccatctcgatttcgagtatcagacccgaggtgcaagtctctcttagctgcttgttcggccagtctggaggggagctgtatgccactaccacaagtggcacataacctggggttttacttctccccagacagtccagcatttgcacctctgccaaaggagttagcgccacattggccagtggttactcaccagaacaatcgggcgtggcccgatcgacttgtcgctagtatgcgcccaattgatgcccgctacagcaagccaatggtcggtgcagggtatgtggtcgggccgtccacctttcttggtactcctggtgtagtgtcatactacctcacgctatacatcaggggtgagccccaggccttgccagagacactcgtttcaacaggacgcatagccactgactgccgggagtatctcgacgcggctgaggaagaggcagcaaaagaactcccccacgcattcattggcgatgtcaaaggtaccacggtcggggggtgtcaccacatcacatcaaaatacctacccaggaccctgcctaaggactctgttgctgtagttggagtaagctcgcccggcagggctgctaaagccatgtgcactctcactgatgtgtatctccccgaactccggccatacctgcaacctgagacggcgtcgaaatgctggaaactcaaattagacttcagggacgtccgactaatggtctggaaaggagccaccgcccatttccagttggaaggacttacatggtcagcgctgcctgactatgccaggtttattcagcttcccaaggacgccgttgtgtacattgatccgtgtataggaccggcaacagccaaccgcaaggtcgtgcgaaccacagactggcgggccgacctggcagtgacaccgtatgattacggtgcccagaacattttgacaacagcctggttcgaggacctcgggccgcagtggaagattttggggttgcagcccttcaggcgggcatttggctttgaaaatactgaggattgggcaatccttgcacgccgtatgagtgacggcaaagactacactgactacaactgggattgtgttcgagaacgcccacacgccatctacgggcgtgctcgtgaccatacatatcattttgcccccggcacggaattgcaggtagagctgggtaaaccccggctgccgcctggacgagagccgtaaacttggagtgatgcaatggggtcactgtggagtaaaatcagccagctgttcgtggatgccttcactgagtttcttgtcagtgtggttgatattgtcattttccttgccatactgtttgggttcaccgtcgcaggatggttattggtctttcttctcagagtggtttgctccgcgcttctccgttcgcgctctgccattcactctcccgaactatcgaaggtcctatgaaagcttgttgcccaactgcaggccggatgtcccacaatttgcatttaagcacccattgggtatactttggcacatgcgagtttcccacctgattgatgagatggtctctcgccgcatttaccagaccatggaacattcaggtcaagcggcctggaaatatgtggtcggtgaggccactctcacgaagctatcaaagcttgatatagttactcatttccaacatctggccgcagtagaggcggattcttgccgctttctcagctcacgactcgtgatgctaaaaaatcttgccgttggcaatgtgagcctacagtacaacaccacgttggatcgcgttgaactcattttccccacgccaggtacgaggcccaagttgaccgacttcagacaatggctcatcagtgtgcatgcttccattttttcctctgtggcttcatctgttaccttgttcatagtgctttggctgcgaattccagctctacgctatgtttttggtttccattggcccacggcaacacatcattcgagctgaccatcaattataccatatgcatgccctgtcttaccagtcaagcagctcgccaaaggctcgagcccggtcgtaacatgtggtgcagaatagggcatgataggtgtgaggagcgtgaccatgatgagttgttaatgtccatcccgtccgggtacgacaacctcaaacttgagggatattatgcttggctggcttttttgtccttttcctacgcggcccaattccatccggagctgttcgggatagggaatgtgtcgcgcgtcttcgtggacaagcgacaccagtttatttgtgccgagcatggtggactcaattcaaccttatctaccgagcacaatatctccgcattatatgcggtatattatcaccaccaaatagacgggggtaattggttccatttggaatggctgcggccgcttttttcctcctggttggtgctcaacatatcatggtttctgaggcgttcgcctgtaagccctgtttctcgacgcatctatcagatattaagaccaacacgaccgcggctgccggtttcatggtccttcagaacatcaattgttcccggcctcacgaggcctcagcaacgcaaggtcaagttccctccagaaagtcgtcccaatgccgtgaagccgtcggtgttccccaatacatcacgataacggccaacgtgaccgacgaatcatatttgtacaacgcggacttgctgatgctttctgcgtgccttttctacgcctcggaaatgagcgagaaaggctttaaagttatctttgggaatgtctctggcgttgtttctgcttgtgtcaatttcacagattatgtggcccatgtgacccaacatacccagcagcatcatctggtgattaatcacatccggttactgcacttcctgacaccatctgcaatgaggtgggctacaaccattgcttgtctgttcgccattctcttggcgatatgaaatgttctcacaaattggggcattccttgactccgcactcttgcttctggtggctttttttgctgtgtaccggcttgtcctggtcctttgccgatggcaacggcaacaactcgacataccaatacatatataatttgacgatatgcgagttgaatgggaccaattggctgtccggccattttgaatgggcagttgagacctttgtgctttacccggttgtcactcatatcctctcactgggttttctcacgacaagtcatttttttgacgcgctcggtctcggcgctgtatccactgcaggatttgtcggagggcggtatgtacttagcagcgtctacggcgcttgtgctttcgcagcgttcgtatgcttcgtcatccgtgctgctaaaaattgcatggcctgccgctatgcccgtacccggttcaccaacttcattgtggacgaccgggggggagttcatagatggaagtctccaatagtggtagaaaaactgggcaaagccgaaattggcggcaaccttgtcaccatcaaacatgtcgtcctcgaaggggttaaagctcaacccttgacgagaacttcggccgagcaatgggaggcctagataatttttgcaacgatcctaccgccgcacaaaagatcgtgctagccttcagcatcacatacacacctataatgatatacgcccttaaggtgtcacgcggccgactcctggggctgttgcacatcctaatatttctgaactgttcctttacattcggatacatgacatatgtgcattttcattctacccaccgtgtcgcacttaccctgggggctgttgtcgcccttttgtggggtgtctacagcctcacagagtcatggaagtttatcacttccagatgcagattgtgttgcctcggccggcgatacattctggcccctgcccatcacgtagaaagtgctgcaggtctccattcaatctcagcgtctggtaaccgagcatacgctgtgagaaagcccggactaacatcagtgaacggcactctagtaccaggacttcggagcctcgtgctgggcggcaaacgagctgttaaacgaggagtggttaacctcgtcaagtatggccggtaaaaatcagagccagaagaaaaagaaaagtacggctccaatggggaatggccagccagtcaatcaactgtgccagttgctgggtgcaatgataaagtcccagcgccagcaacctaggggaggacaggctaaaaagaaaaagcctgagaagccacattttcccctggctgcagaagatgacatccggcaccacctcacccaaactgaacgctccctctgcttgcaatcgatccagacggctttcaatcaaggcgcaggaactgcgtcgctttcatccagcgggaaggtcagtttccaggttgagtttatgctgccggttgctcatacagtgcgcctgattcgcgtgacttctacatccgccagtcagggtgcaaattaatttgacagtcaggtgaatggccgcgattggcgtgtggcctctgagtcacctattcaattagggcgatcacatgggggtcatacttaatcaggcaggaaccatgtgaccgaaatt

SEQ ID NO: 94 - DNA, 15047 bp, Porcine reproductive and respiratory syndrome virus
atgatgtgtagggtatcccccctacatacacaacactttttgtgtttgtgtactttggaggcgtgggtacagccccgccccaccccttggcccctgttctagcccaacaggtatccttctccctcggggcgagtgcgccgcctgctgctcccttgcagtgggaaggacctcccgagtatttccggagagcacctgctttacgggatctccaccctttaaccatgtctgggacgttctcccggtgcatgtgcaccccggctgcccgggtattttggaacgccggccaagtcttttgcacacggtgtctcagtgcgcggcctcttctctctccggaacttcaggacactgacctcggtgtagttggattgttttacaagcctaaggacaagattcactggaaagttcctatcggcattcctcaggtggagtgtactccatccgggtgctgctggctctcagccgtattccctttggcgcgcatgacttccggtaatcacaacttcctccaacgacttgttaaggttgctgatgttttgtatcgcgatggttgcttggcgcctcgacacctccgtgaactccaagtttacgagcgcggttgtagctggtacccaattacggggcccgtacccggaatgggtttgtttgcgaactccatgcacgtgtctgaccagccgttccctggtgccacccatgtgttgactaactcgcctctgcctcagcgggcgtgccggcagccgttctgtccatttgaggaagctcattctgacgtttacaggtggaagaaatttgtgatttttacggactcctctcccaacggtcgatttcgcatgatgtggacgccggaatccgatgactcagccgccctggaggtgctgccgcccgagttagaacgtcaggtcgagatcctcactcggagttttcccgctcatcaccctatcaacctagctgactgggagctcactgagtcccctgagaacggtttttctttcggcacgtcccattcttgcggccacatcgtccagaaccccaacgtgtttgacggcaagtgctggctcacctgctttttgggccaatcggctgaagtgtgctaccacgaggaacatctagctaacgccctcggttaccaaaccaagtggggcgtgcatggtgcgtacctccaagccaggcttcaagtccgcggcatgcgtgctgtggtcgatcctgacggccctattcacgttgaagcgctgtcttgctcccagtcttgggtcaggcacctgactctgaataatgatgtcaccccaggattcgttcgcctgacatccatccgcattgtgtccaacacagaacccaccgctttccggatctttcggtttggagcacataagtggtatggcgctgccggcaaacgggctcgtgccaaacgtgccaccaaaagtgggaaggattcggccctcgctcccaagattgccccaccggtccccacctgtggaatcaccacctactctccaccgacagacgggtcttgtggttggcacgttcttgccgccatagtgaatcggatgataaacggtgactttacgtcccccctgcctcagtacaacagaccagaggatgattgggcttctgattatgatcttgctcaggcgattcaatgtttacaactgcctgccaccgtggttcggaatcgcgcctgtcctaacgccaagtacctcataaagctaaacggggttcactgggaagtagaggtgagatctggaatggctcctcgttccctttctcgtgaatgtgtagttggcgtttgctctgaaggctgtgtcgcaccgccttatccagcggacgggcttcctaaacgtgcactcgaggccttggcgtctgcctacagactaccctcagattgtgttagctctggtattgctgactttcttgctgatccacctcctcaggaattctggactctcgacaaaatgttgacctccccgtcaccggagcggtccggcttctccagcttgtataaattactcttagaggttgttccgcaaaaatgtggtgctacggaaggggctttcgtctatgctgttgagaggatgttaaaggactgtccgagccccgaacaggccatggcccttctggcaaaaattaaagttccatcctcaaaggccccgtctgtgtccttggacgagtgttttcctgcgggtgttccagccgacttcgagccagcatttcaggaaaggccccaaagtcccggtgctgctgtcgccctgtgttcaccggacgcaaaagggttcgagggaacagcctcggaagaagctcaagagagtggccataaggccgtccacgctgtaccccttgccgaaggtcccaataatgaacaggtacaggtggttgctggtgagcagctagagctcggcggttgtggtttggcaatcgggagtgctcagtcctcttcagactccaagagagaaaacatgcacaatagccgggaagacgaaccattggatttgtcccacccagcaccggctgccacgacgacccttgtgggagagcaaacacccgacaacccaggttctgatgccagtgctctccccatcgccgttcgaggatttgtcccgacagggcccatactccgtcatgttgagcactgcggcacagagtcaggcgacagcagttcgcctttggatctgtcttttgcgcaaacgttggaccagcctttagatctatccttggccgcttggccggtgaaggccaccgcgtctgatcctggctgggtccgcggtaggtgcgagcctgtctttttaaagcctcggaaagctttctctgatggcgattcggcccttcagttcggggagctttctgagtccagctctgtcatcgagtttgaccagacaaaagatactctggtggctgacgcccctgttgacttgacgacttcgaacgaggccctctctgcagtcgacccttccgaatttgtcgaactcaggcgcccgcgtcattccgcacaagccttaattgaccgaggcggtccacttgctgatgtccatgcgaaaataaagaaccgggtgtatgaacagtgcctccaagcttgtgagcctggtagtcgtgcaaccccagccaccagggagtggctcgacaaaatgtgggatagggtggacatgaaaacttggcgctgcacttcacagttccaggccggtcgcattcttgcgtccctcaaatttcttcctgacatgattcaagacacgccgcctcctgtccccaagaagaaccgagctagtgacagtgccggtctgaagcaactggtggcacggtgggataagaaattgagtgtaaccccccccccaaaatcggctgggttagtgcttgaccagaccgtccctccgcctacggatatccagcaagaggatgccaccccctccgacgggttatcccatgcatcggatttttctagtcgagtgagcacgagctggagttggaaaggccttatgctttccggcacccgtctcgcggggtctgctggtcagcgcctcatgacatgggtttttgaagtttactcccatctcccagcttttatactcacacttttctcgccgcggggctctatggctccaggcgattggttgtttgcaggtgttgttttacttgctctcttgctctgtcgttcttacccaatactcggatgccttcccttactgggtgtcttctctggttctttgcggcgtgttcgtctgggtgtttttggttcttggatggcttttgctgtatttttattctcgactccatccaacccagtcggttcttcttgtgaccacgattcgccggaatgtcatgctgagcttttggctcttgagcagcgccaactttgggaacctgtgcgcggccttgtggttggcccctcaggtctcttatgtgtcatccttggcaagttactcggtgggtcacgtcatctctggcatgttatcctacgtttatgcatgcttacagatttggccctttctcttgtttatgtggtgtcccaagggcgttgtcacaagtgttggggaaagtgtataaggacagctcctgctgaggtggctctcaatgtatttcctttctcgcgcgccactcgcaactctctcacatccttgtgtgatcggttccaaactcctaaaggagttgatcccgtgcacttggcaacgggttggcgcgggtgttggcgtggtgagagtcccatccatcaaccacaccaaaagcccatagcttatgccaatttggatgaaaagaaaatatctgctcaaacggtggttgctgtcccatacgaccccagtcaggctatcaaatgtctgaaggttctgcaggcgggaggggctatcgtggaccagcctacgcctgaagttgttcgtgtgtctgaaatccccttttcagccccatttttcccaaaagttccagtcaacccagattgcaggattgtggtggattcagatacttttgtggctgcagtccgctgcggttactcgacagcacaactggtcctaggccggggcaactttgccaagttgaatcagaccccccttagggactctgcctccaccaaaacgactggtggggcctcttatactcttgctgtggctcaagtgtctgtgtggactcttgttcatttcatcctcggtctttggttcacatcacctcaagtgtgtggccgaggaaccgctgacccatggtgttcaaatcccttttcgtatcctgcctacggccctggagttgtgtgctcctctcgactttgtgtgtctgccgatggggtcaccctgccattgttctcagctgtggcacaactctccggtagagaggtagggatttttattttagtgcttgtttccttgactgccttggcccatcgcctggctcttaaggcagacatgttagtggtcttttcagctttttgtgcttacgcctggcccatgagctcctggttaatctgcttctttcctatactcttaaagtgggttacccttcaccccctcactatgctttgggtgcactcattcttggtgttttgtatgccagcagccggcatcctctcactagggataactggccttctctgggcagttggccgctttacccaggttgccggaattattacaccttatgacatccaccagtatacctctgggccacgcggtgcagccgctgtagccacagccccagaaggcacttatatggccgccgtccggagagctgctttaactggacgaactttgatcttcaccccgtctgcggtcggatcccttcttgaaggtgctttcaggactcataaaccctgccttaacaccgtgaatgttgtgggttcttcccttggttctggaggggtttttaccattgatggcagaaagaccgtcgtcactgctgctcatgtgttgaacggcgacacagctagagttaccggcgactcttacaaccgcatgcacacttttaagaccagtggcgattatgcctggtcccatgctgatgactggcagggcgttgcccctgtggtcaaggttgcgaaggggtatcgcggtcgtgcctactggcaaacatcaaccggtgtcgaacccggcgtcattggggaagggttcgccttctgtttcaccaactgtggcgattcggggtcacccgtcatctcagaatctggtgatctcatcggaatccataccggttcaaacaaactcggttctggtcttgtgacgacccctgaaggggaaacctgcgccatcaaagaaaccaagctctctgacctttccagacattttgcgggcccgagcgtccctcttggggacattaaattgagtccggccatcgtccctgatgtaacatctattccgagtgacttggcatcgctcctagcttccgtccctgtaatggaaggcggcctctcgaccgttcaacttctgtgtgtctttttccttctctggcgcatgatgggccatgcctggacacccattgttgccgtgggcttctttttgctgaatgaaattcttccagcagttttggtccgagccgtgttttcctttgcactctttattcttgcatgggccaccccctggtccgcacaggtgttaatgattagactcctcacggcatccctcaaccgcaacaagttgtctctggcgttctacgcacttgggggtgtcgtcggtttggccgctgaaatcggggcttttgccggcaggctgcctgaattgtctcaagctctttcgacatactgtttcttacctagggtccttgccatggccagttatgttcccatcatcatcattggtggactccatgccctcggtgtgattctgtggttgttcaaataccggtgcctccacaacatgctggttggtgatgggagtttctcaagcgctttcttcctacggtattttgcagagggtaatcttagaaaaggtgtttcacagtcttgtggcatgagtaacgagtccctgacggctgctctagcttgcaagttgtcgcaggctgaccttgactttttgtccagcttaacgaacttcaagtgctttgtatctgcttcaaacatgaaaaatgctgccggccagtatattgaagcagcgtatgccaaggccctgcgccaagagttggcctccctagttcaggttgacaaaatgaaaggaattttgtctaagcttgaggcctttgctgaaacagccactccgtcccttgacgcaggtgacgtggttgttctgcttgggcaacatcctcacggatccatcctcgatattaatgtggggactgaaaggaaaactgtgtccgtgcaagagacccggagcttaggtggttccaaattcagtgtttgcactgtcgtgtccaacacacccgtggacgccttaactggcatcccactccagacaccaacccctctttttgagaatggtccgcgtcaccgtggtgaggaagacgatcttagagtcgagaggatgaagaaacactgtgtgtccctcggcttccacaacattaatggcaaagtttactgcaaaatttgggacaagtccaccggtgataccttttataccgatgattcccggtacacccaagaccttgcattccaggacaggtcagccgactacagagacagggattatgagggtgtgcaaaccgccccccaacagggctttgatccaaagtctgaaacccctattggcactgtggtgatcggcggtatcacgtataacaggtacctgatcaaaggtaaggaggtcttggttcccaagcctgacaactgccttgaagctgccaagctgtcccttgagcaagctctcgctgggatgggccaaacttgcgaccttacagctgccgaggtggaaaagttgaggcgcatcattagccagctccaaggtttgaccactgaacaggctttaaactgttagccgccagcggcttgacccgctgtggccgcggcggcttagttgtaactgaaacagcggtaaaaatcgtaaagtaccacagcagaactttcaccctaggccctctggacctgaaagtcacctccgaggctgaggtaaagaaatcaactgagcagggccacgctgttgtggcaaacttatgttctggtgtcatcttgatgagacctcacccaccgtcccttgttgatgttcttctgaaacccggacttgacacaaaacccggcattcaaccagggcatggggccgggaatatgggcgtagacggctctacttgggattttgaaaccgcacccacaaaggcagaacttgagttgtccaaacaaataattcaagcatgtgaagttaggcgcggggacgccccgaacctccaactcccttacaagctctatcctgttagaggggatcctgagcggcatgggggccgccttatcaataccaggtttggagatctatcttacaaaacccctcaagacaccaagtccgcaatccatgcggcttgttgcctgcaccccaacggggcccctgtgtctgatggtaagtcaacactaggtaccacccttcaacatggtttcgaactttatgtccccactgtgccctatagtgtcatggagtacctcgattcacgccctgacacccctttcatgtgcactaaacatggtacttccaaggctgctgcagaagacctccaaaaatacgacctatctactcaaggatttgtcctgcccggggtcttacgccttgtacgcagattcatctttggccatattggtaaggcaccgccattgttcctcccgtcaacctatcccgctaaaaattctatggcagggatcaatggccagaggttcccaacaaaggacgtccagagcatacctgaaattgacgaaatgtgtgcccgcgccgtcaaggagaattggcaaactgtgacaccttgtaccctcaagaaacagtactgttccaagcccaaaaccaggaccatcctgggcaccaacaactttattgccctggctcaccgatcggcgctcagtggtgtcacccaggcattcatgaagaaggcttggaagtccccgattgccttgggaaaaaacaaattcaaggagctgcattgcactgtcgccggcaggtgtcttgaagccgacttggcctcctgtgaccgcagcacccccgccattgtgaggtggttcgtcgccaacctcctgtatgaacttgcaggatgtgaagagtacttgcctagctatgtgcttaactgctgccatgaccttgtggcaacacaggatggtgccttcacaaaacgcggtggcctgtcgtccggggaccccgtcaccagtgtgtctaacaccgtatattcactgataatctatgcccagcacatggtgttgtcggccttaaaaatgggtcatgaaatcggtctcaagttcctcgaggaacagctcaaattcgaggacctcctcgaaatccagcctatgttggtctattctgatgaccttgtcttgtacgctgaaaggcccacttttcctaattatcactggtgggtcgagcaccttgacctaatgctgggtttcagaacggacccaaagaagacagtcataactgataaacccagcttcctcggctgcagaattgaggcggggcgacagctggtccctaatcgcgaccgcatcctggctgctctcgcatatcacatgaaggcgcagaacgcctcagagtattatgcgtctgctgccgcaatcctgatggattcatgtgcttgcattgatcatgaccctgagtggtatgaggacctcatctgcggtatcgcccgatgcgcccgccaggatggttatagtttcccaggcccggcatttttcatgtccatgtgggaaaagctgagaagtcacaatgaagggaagaaatttcgacactgcggcatctgcgacgccaaagccgaccatgcatccgcctgtgggcttgatttgtgtttgttccactcacactttcatcaacactgccccgtcactctgagctgtggtcatcatgccggttcaagggaatgttcgcagtgtcagtcacctgttggggctggcagatctcctcttgatgccgtgctaaaacaaatcctgtacaaacctcctcgtacagtcatcatgaaggtgggtaacaaaacaacggccctcgatccggggaggtaccagtcccgtcgaggtcttgttgcagtcaagaggggtattgcaggcaatgaagttgatcttcctgatggggactaccaagtagtgcctcttttaccaacttgtaaagacataaacatggtaaaggtggcttgcaatgtactactcagtaagttcatagtggggccaccaggttccggaaagaccacctggttactgagtcaagtccaggacgatgatgtcatttacacacccacccatcagaccatgtttgatatagtcagtgctctcaaagtttgcaggtattctattccaggagcctcaggacttcctttcccaccacctgccaggtccgggccgtgggttaggctcgtggccagcgggcacgtccccggccgaacatcatacctcgatgaggctggatattgtaatcatctggacattctcagactgctttccaaaacacccctcgtgtgtttgggtgaccttcaacaacttcaccctgtcggctttgactcctactgttatgtgtttgatcagatgcctcaaaagcaactgaccactatttatagatttggccctaacatctgcgcagccatccagccttgttacagggagaagcttgaatctaaggctaggaacaccagggtggtctttaccacctggcctgtggcctttggtcaggtgctgacaccataccataaagatcgcatcggctctgcgataaccatagactcatcccagggggccactttcgacattgtgacattgcatctaccatcaccaaagtccctaaataaatcccgagcacttgtagccatcactcgggcaagacacgggttgttcatttatgaccctcacaaccagctccaggagtttttcaacctgatccctgagcgcactgattgcaaccttgtgttcagccgtggggatgatctggtagttcttagtgcggacaatgcagtcacaactgtagcgaaggccctagggacaggtccatctcgatttcgagtatcagacccgaggtgcaagtctctcttagctgcttgttcggccagtctggaggggagctgtatgccactaccacaagtggcacataacctggggttttacttctccccagacagtccagcatttgcacctctgccaaaggagttagcgccacattggccagtggttactcaccagaacaatcgggcgtggcccgatcgacttgtcgctagtatgcgcccaattgatgcccgctacagcaagccaatggtcggtgcagggtatgtggtcgggccgtccacctttcttggtactcctggtgtagtgtcatactacctcacgctatacatcaggggtgagccccaggccttgccagagacactcgtttcaacaggacgcatagccactgactgccgggagtatctcgacgcggctgaggaagaggcagcaaaagaactcccccacgcattcattggcgatgtcaaaggtaccacggtcggggggtgtcaccacatcacatcaaaatacctacccaggaccctgcctaaggactctgttgctgtagttggagtaagctcgcccggcagggctgctaaagccatgtgcactctcactgatgtgtatctccccgaactccggccatacctgcaacctgagacggcgtcgaaatgctggaaactcaaattagacttcagggacgtccgactaatggtctggaaaggagccaccgcccatttccagttggaaggacttacatggtcagcgctgcctgactatgccaggtttattcagcttcccaaggacgccgttgtgtacattgatccgtgtataggaccggcaacagccaaccgcaaggtcgtgcgaaccacagactggcgggccgacctggcagtgacaccgtatgattacggtgcccagaacattttgacaacagcctggttcgaggacctcgggccgcagtggaagattttggggttgcagcccttcaggcgggcatttggctttgaaaatactgaggattgggcaatccttgcacgccgtatgagtgacggcaaagactacactgactacaactgggattgtgttcgagaacgcccacacgccatctacgggcgtgctcgtgaccatacatatcattttgcccccggcacggaattgcaggtagagctgggtaaaccccggctgccgcctggacgagagccgtaaacttggagtgatgcaatggggtcactgtggagtaaaatcagccagctgttcgtggatgccttcactgagtttcttgtcagtgtggttgatattgtcattttccttgccatactgtttgggttcaccgtcgcaggatggttattggtctttcttctcagagtggtttgctccgcgcttctccgttcgcgctctgccattcactctcccgaactatcgaaggtcctatgaaagcttgttgcccaactgcaggccggatgtcccacaatttgcatttaagcacccattgggtatactttggcacatgcgagtttcccacctgattgatgagatggtctctcgccgcatttaccagaccatggaacattcaggtcaagcggcctggaaatatgtggtcggtgaggccactctcacgaagctatcaaagcttgatatagttactcatttccaacatctggccgcagtagaggcggattcttgccgctttctcagctcacgactcgtgatgctaaaaaatcttgccgttggcaatgtgagcctacagtacaacaccacgttggatcgcgttgaactcattttccccacgccaggtacgaggcccaagttgaccgacttcagacaatggctcatcagtgtgcatgcttccattttttcctctgtggcttcatctgttaccttgttcatagtgctttggctgcgaattccagctctacgctatgtttttggtttccattggcccacggcaacacatcattcgagctgaccatcaattataccatatgcatgccctgtcttaccagtcaagcagctcgccaaaggctcgagcccggtcgtaacatgtggtgcagaatagggcatgataggtgtgaggagcgtgaccatgatgagttgttaatgtccatcccgtccgggtacgacaacctcaaacttgagggatattatgcttggctggcttttttgtccttttcctacgcggcccaattccatccggagctgttcgggatagggaatgtgtcgcgcgtcttcgtggacaagcgacaccagtttatttgtgccgagcatggtggactcaattcaaccttatctaccgagcacaatatctccgcattatatgcggtatattatcaccaccaaatagacgggggtaattggttccatttggaatggctgcggccgcttttttcctcctggttggtgctcaacatatcatggtttctgaggcgttcgcctgtaagccctgtttctcgacgcatctatcagatattaagaccaacacgaccgcggctgccggtttcatggtccttcagaacatcaattgttcccggcctcacgaggcctcagcaacgcaaggtcaagttccctccagaaagtcgtcccaatgccgtgaagccgtcggtgttccccaatacatcacgataacggccaacgtgaccgacgaatcatatttgtacaacgcggacttgctgatgctttctgcgtgccttttctacgcctcggaaatgagcgagaaaggctttaaagttatctttgggaatgtctctggcgttgtttctgcttgtgtcaatttcacagattatgtggcccatgtgacccaacatacccagcagcatcatctggtgattaatcacatccggttactgcacttcctgacaccatctgcaatgaggtgggctacaaccattgcttgtctgttcgccattctcttggcgatatgaaatgttctcacaaattggggcattccttgactccgcactcttgcttctggtggctttttttgctgtgtaccggcttgtcctggtcctttgccgatggcaacggcaacaactcgacataccaatacatatataatttgacgatatgcgagttgaatgggaccaattggctgtccggccattttgaatgggcagttgagacctttgtgctttacccggttgtcactcatatcctctcactgggttttctcacgacaagtcatttttttgacgcgctcggtctcggcgctgtatccactgcaggatttgtcggagggcggtatgtacttagcagcgtctacggcgcttgtgctttcgcagcgttcgtatgcttcgtcatccgtgctgctaaaaattgcatggcctgccgctatgcccgtacccggttcaccaacttcattgtggacgaccgggggggagttcatagatggaagtctccaatagtggtagaaaaactgggcaaagccgaaattggcggcaaccttgtcaccatcaaacatgtcgtcctcgaaggggttaaagctcaacccttgacgagaacttcggccgagcaatgggaggcctagataatttttgcaacgatcctaccgccgcacaaaagatcgtgctagccttcagcatcacatacacacctataatgatatacgcccttaaggtgtcacgcggccgactcctggggctgttgcacatcctaatatttctgaactgttcctttacattcggatacatgacatatgtgcattttcattctacccaccgtgtcgcacttaccctgggggctgttgtcgcccttttgtggggtgtctacagcctcacagagtcatggaagtttatcacttccagatgcagattgtgttgcctcggccggcgatacattctggcccctgcccatcacgtagaaagtgctgcaggtctccattcaatctcagcgtctggtaaccgagcatacgctgtgagaaagcccggactaacatcagtgaacggcactctagtaccaggacttcggagcctcgtgctgggcggcaaacgagctgttaaacgaggagtggttaacctcgtcaagtatggccggtaaaaatcagagccagaagaaaaagaaaagtacggctccaatggggaatggccagccagtcaatcaactgtgccagttgctgggtgcaatgataaagtcccagcgccagcaacctaggggaggacaggctaaaaagaaaaagcctgagaagccacattttcccctggctgcagaagatgacatccggcaccacctcacccaaactgaacgctccctctgcttgcaatcgatccagacggctttcaatcaaggcgcaggaactgcgtcgctttcatccagcgggaaggtcagtttccaggttgagtttatgctgccggttgctcatacagtgcgcctgattcgcgtgacttctacatccgccagtcagggtgcaaattaatttgacagtcaggtgaatggccgcgattggcgtgtggcctctgagtcacctattcaattagggcgatcacatgggggtcatacttaatcaggcaggaaccatgtgaccgaaatt

SEQ ID NO: 95 - DNA, 15432 bp, Porcine reproductive and respiratory syndrome virus
tatgacgtataggtgttggctctatgccttggcatttgtattgtcaggagctgtgaccattggcacagcccaaaacttgcttcacagaaacacccttctgtgatagcctccttcaggggagcttagggtttgtccctagcaccttgcttccggagttgcactgctttacggtctctccacccctttaaccatgtctgggatacttgatcggtgcacgtgtacccccaatgccagggtgtttatggcggagggccaagtctactgcacacgatgcctcagtgcacggtctctccttcccctgaacctccaagtttctgagctcggggtgctaggcctattctacaggcccgaagagccactccggtggacgttgccacgtgcattccccactgttgagtgctcccccgccggggcctgctggctctctgcaatctttccaatcgcacgaatgaccagtggaaacctgaacttccaacaaagaatgatacgggtcgcagctgagctttacagagccggccagctcacccctgcagtcttgaaggctctacaagtttatgaacggggttgccgctggtaccccattgttggacctgcccctggagtggccgtttacgccaattccctacatgtgagtgataaacctttcccgggagcaactcacgtgttgaccaacctgccgctcccgcagagacccaagcctgaagacttttgcccctttgagtgtgctatggctactgtctatgacattggtcatgacgccgtcatgtatgtggccgaaaggaagatctcctgggcccctcgtggcggggatgaagtgaaatttgaagctgtccccggggagttgaggttgattgcgaaccggctccgcacctccttcccgccccaccacacagtggacatgtctaagttcgccttcacagcccctgggtgtggtgtttctatgcgggttgaacgccaacacggctgccttcccgctgacactgtccctgaaggcaactgctggtggagcttgtttgactcgcttccactggaagttcagaacaaagaaattcgccatgctaaccaatttggctaccagaccaagcatggtgtctctggcaagtacctacagcggaggctgcaagttaatggtctccgagcagtaactgacctaaacggacctatcgtcgtacagtacttctccgttaaggagagttggatccgccatttgaaactggcgggagaacccagctactctgggtttgaggacctcctcagaataagggttgagcctaacacgtcgccattggctgacaaggaagaaaaaattttccggtttggcagtcacaagtggtacggcgctggaaagagagcaagaaaagcacgctcttgtgcgactgccacagtcgctggccgcgctttgtccgttcgtgaaactcggcaggccaaggagcacgaggttgccggcgcctacaaggctgagcacctcaaacactactccccgcctgccgaagggaattgtggttggcactgcatttccgccatcgccaaccggatggtgaattccaaatttgaaaccacccttcccgaaagagtgagacctccagatgactgggctactgacgaggatcttgtgaatgccatccaaatcctcagactccctgcggccttagacaggaacggtgcttgtactagcgccaagtacgtacttaagctggaaggtgagcattggactgtcactgtggcccctgggatgtccccttctttgctccctcttgaatgtgttcagggctgttgtgggcacaagggcggtcttggttccccagatgcagtcgaggtctccggatttgaccctgcctgccttgaccggctggctgaggtgatgcacctgcctagcagtgctatcccagccgctctggccgaaatgtctggcgattccgatcgttcggcttctccggtcaccaccgtgtggactgtttcgcagttctttgcccgtcacagcggagggaatcaccctgatcaagtgcgcttagggaaaattatcagcctttgtcaggtgattgaggactgctgctgttcccagaacaaaaccaaccgggtcaccccggaggaggtcgcagcaaagattgacctgtacctccgtggtgcaacaaatcttgaagaatgcttggccaggcttgagaaagcgcgcccgccacgcgtaatcgacaccttctttgattgggatgttgtgctccctggggttgaggcggcaacccagacgatcaagctgccccaggtcaaccagtgtcgtgctctggtccctgttgtgactcaaaagtccttggacgacaactcggtccccctgaccgccttttcactggctaactactactaccgtgcgcaaggtgacgaagttcgtcaccgtgaaagactaaccgccgtgctctccaagttggaaaaggttgttcgagaagaatatgggctcatgccaaccgagcctggtccacggcccacactgccacgcgggctcgacgaactcaaagaccagatggaggaggacttgctgaagctggctaacgcccagacgacttcggacatgatggcctgggcagtcgagcaggttgacctaaaaacttgggtcaagaactacccgcggtggacaccaccaccccctccgccaaaagttcagcctcgaaaaacgaagcctgtcaagagcttgccggagagaaagcctgtccccgccccgcgcaggaaggttgggtccgattgtggcagcccggtttcattaggcggcgatgtctctaacagttgggaagatttggctgttagtagcccctttgatctcccgaccccacctgagccggcaacaccttcaagtgagctggtgattgtgtcctcaccgcaatgcatcttcaggccggcgacacccttgagtgagccggctccaattcccgcacctcgcggaactgtgtctcgaccggtgacacccttgagtgagccgatccctgtgcccgcaccgcggcgtaagtttcagcaggtgaaaagattgagttcggcggcggcaatcccaccgtaccagaacgagcccctggatttgtctgcttcctcacagactgaatatgaggcctctcccccagcaccgccgcagagcgggggcgttctgggagtagaggggcatgaagctgaggaaaccctgagtgaaatctcggacatgtcgggtaacattaaacctgcgtccgtgtcatcaagcagctccttgtccagcgtgagaatcacacgcccaaaatactcagctcaagccatcatcgactcgggcgggccctgcagtgggcatctccaagaggtaaaggaaacatgccttagtgtcatgcgcgaggcatgtgatgcgactaagcttgatgaccctgctacgcaggaatggctttctcgcatgtgggatcgggtggacatgctgacttggcgcaacacgtctgtttaccaggcgatttgcaccttagatggcaggttaaagttcctcccaaaaatgatactcgagacaccgccgccctatccgtgtgagtttgtgatgatgcctcacacgcctgcaccttccgtaggtgcggagagcgaccttaccattggctcagttgctactgaagatgttccacgcatcctcgagaaaatagaaaatgtcggcgagatggccaaccagggacccttggccttctccgaggataaaccggtagatgaccaacttgtcaacgacccccggatatcgtcgcggaggcctgacgagagcacatcagctccgtccgcaggcacaggtggcgccggctcttttaccgatttgccgccttcagatggcgcggatgcggacgggggggggccgtttcggacggcaaaaagaaaagctgaaaggctctttgaccaactgagccgtcaggtttttgacctcgtctcccatctccctgttttcttctcacgccttttctaccctggcggtggttattctccgggtgattggggttttgcagcttttactctattgtgcctctttttatgttacagttacccagcctttggtattgctcccctcttgggtgtgttttctgggtcttctcggcgcgtgagaatgggggtttttggctgctggttagcttttgctgtaggtctgttcaagcctgtgtccgacccagtcggcgctgcttgtgagtttgactcgccagagtgtagaaacatccttcattcttttgagcttctcaaaccttgggaccctgttcgcagccttgttgtgggccccgtcggtctcggtcttgccattcttggcaggttactgggcggggcacgctgcatctggcactttttgcttaggcttggcattgttgcagactgtatcttggctggagcttacgtgctttctcaaggtaggtgtaaaaagtgctggggatcttgtataagaactgctcctaatgaggtcgcttttaacgtgtttcctttcacacgtgcgaccaggtcgtcacttatcgacctgtgcgatcggttttgtgcgccaaaaggaatggaccccatttttctcgccactgggtggcgcgggtgctgggccggccgaagccccattgagcaaccctctgaaaaacccatcgcgtttgcccaattggatgaaaagaagattacggctaggactgtggtcgcccagccttatgaccccaaccaagccgtaaagtgcttgcgggtattgcaggcgggtggggcgatggtggctaaggcggtcccaaaagtggttaaggtttccgctgttccattccgagctcccttctttcccactggagtgaaagttgaccctgattgcagggtcgtggttgaccctgacactttcactgcagctctccggtctggctactccaccacaaacctcgtccttggtgtaggggactttgcccagctaaatggattaaaaatcaggcaaatttccaagccttcagggggaggcccacatctcatggctgccctgcatgttgcctgctcgatggctctgcacatgcttgctgggatttatgtgactgcggtgggttcttgcggcaccggcaccaacgacccgtggtgcgctaacccgtttgccgtccctggctacggacctggctctctctgtacgtccagattgtgcatttcccaacacggccttaccctgcccttgtcagcacttgtggcgggattcggtattcaagaaattgccttggtcgttttgatttttgtttccatcggaggcatggctcataggttgagctgtaaggctgacatgctgtgtgttttgcttgcaattgccagctatgtttgggtacctcttacctggttgctttgtgtgtttccttgctggttgcgctgtttttctttgcaccccctcaccatcctatggttggtgtttttcttgatttctgtgaatatgccttcaggaatcttggccatggtgttgttggtttctctttggcttcttggtcgttatactaatgttgctggccttgtcaccccctacgacattcatcattacaccagtggcccccgcggtgttgccgccttggctaccgcaccagatgggacctacttggccgctgtccgccgcgctgcgttgactggccgcaccatgctgtttaccccgtcccagcttgggtctcttcttgagggtgctttcagaactcgaaagccctcactgaacaccgtcaatgtgatcgggtcctccatgggctctggcggggtgtttaccatcgacgggaaagtcaagtgcgtaactgccgcacatgtccttacgggcaattcagctcgggtttccggggtcggcttcaatcaaatgcttgactttgacgtaaagggagatttcgctatcgctgattgcccgaattggcaaggggctgcccccaagacccaattctgcacggatggatggactggccgtgcctattggctaacatcctctggcgtcgaacccggcgtcattggaaaaggattcgccttctgcttcaccgcatgtggcgattccgggtccccagtgatcaccgaggccggtgagcttgtcggcgttcacacgggatcgaataaacaaggggggggcattgttacgcgcccctcaggccagttttgtaatgtggcacccatcaagctaagcgaattaagtgaattctttgctgggcctaaggtcccgctcggtgatgtgaaggtcggcagccacataattaaagacataagcgaggtgccttcagatctttgtgccttgcttgctgccaaacctgaactggaaggaggcctctccaccgtccaacttctttgtgtgttttttctcctgtggagaatgatgggacatgcctggacgcccttggttgctgtgagtttctttattttgaatgaggttctccctgccgtcctggtccggagtgttttctcctttggaatgtttgtgctatcctggctcacgccatggtctgcgcaagttctgatgatcaggcttctgacagcagctcttaacaggaacagatggtcacttgcctttttcagcctcggtgcagtgaccggttttgtcgcagatcttgcggccactcaggggcatccgttgcaggcagtgatgaatttgagcacctatgcattcctgcctcggatgatggttgtgacctcaccagtcccagtgatcacgtgtggtgtcgtgcacctacttgccatcattttgtacttgtttaagtaccgtggcctgcaccatatccttgttggcgatggagtgttctctgcggctttcttcttgagatactttgccgagggaaagttgagggaaggggtgtcgcaatcctgcggaatgaatcatgagtctctgactggtgccctcgctatgagactcaatgacgaggacttggatttccttatgaaatggactgattttaagtgctttgtttctgcgtccaacatgaggaatgcagcgggtcaatttatcgaggctgcctatgctaaagcacttagagtagaactggcccagttggtacaggttgataaagttcgaggtactttggccaaacttgaagcttttgctgataccgtggctcctcaactctcgcccggtgacattgttgtcgctctcggccacacgcctgttggcagtatcttcgacctaaaggttggtagcaccaagcataccctccaagccattgagaccagagtccttgctgggtccaaaatgaccgtggcgcgcgtcgtcgacccgacccccacgcccccacccgcacccgtgcccatccccctcccaccgaaagttctggagaatggccccaacgcttggggggatgaggaccgtttgaataagaagaagaggcgcaggatggaagccctcggcatctatgttatgggcgggaaaaagtaccagaaattttgggacaagaattccggtgatgtgttttatgaggaggtccataataacacagatgagtgggagtgtctcagagttggcgaccctgccgactttgaccctgagaagggaactctgtgtggacatgtcaccattgaaaataaggcttaccatgtttacacctccccatctggtaagaagttcttggtccccgtcaacccagagaatggaagagttcaatgggaagctgcaaagctttccgtggagcaggccctaggtatgatgaatgtcgacggcgaactgactgccaaagaactggagaaactgaaaagaataattgacaaactccagggcctgactaaggagcagtgtttaaactgctagccgccagcgacttgacccgctgtggtcgcggcggcttggttgttactgaaacagcggtaaaaatagtcaaatttcacaaccggaccttcaccctgggacctgtgaatttaaaagtggccagtgaggttgagctaaaagacgcggttgagcacaaccaacacccggttgcgagaccgatcgatggtggagttgtgctcttgcgttccgcggttccttcgcttatagacgtcttgatctccggtgctgatgcatctcccaagttacttgcccatcacgggccgggaaacactgggatcgatggcacgctctgggattttgagtccgaagccactaaagaggaagtcgcactcagtgcgcaaataatacaggcttgtgacattaggcgcggcgacgctcctgaaattggtctcccttacaagctgtaccctgttaggggtaaccctgagcgggtgaaaggagttctgcagaatacaaggtttggagacataccttacaaaacccccagtgacactggaagcccagtgcacgcggctgcctgccttacgcccaacgccactccggtgactgatgggcgctccgtcttggccacgaccatgccccccgggtttgagttatatgtaccgaccataccagcgtctgtccttgattaccttgactctaggcctgactgccctaaacagctgacagagcacggctgcgaagatgccgcactgaaagacctctctaaatatgacttgtccacccaaggctttgttttacctggagttcttcgccttgtgcggaaatacctgtttgcccatgtaggtaagtgcccacccgttcatcggccttctacttaccctgctaagaattctatggctggaataaatgggaacaggttcccaaccaaggacattcagagcgtccctgaaatcgacgttctgtgcgcacaggctgtgcgagaaaactggcaaactgtcaccccttgtactcttaagaaacagtattgcgggaagaagaagactaggaccatactcggcaccaataacttcatcgcactagcccaccgagcagtgttgagtggtgttacccagggcttcatgaaaaaggcgtttaactcgcccatcgccctcggaaagaacaagtttaaggagctacagactccggtcctgggcaggtgccttgaagctgatctcgcatcctgcgatcgatccacgcctgcaattgtccgctggtttgccgccaaccttctttatgaacttgcctgtgctgaagagcatctaccgtcgtacgtgctgaactgctgccacgacttactggtcacgcagtccggcgcagtgactaagagaggtggcctgtcgtctggcgacccgatcacctctgtgtctaacaccatttatagtttggtgatctatgcacagcatatggtgcttagttacttcaaaagtggtcacccccatggccttctgttcttacaagaccagctaaagtttgaggacatgctcaaggttcaacccctgatcgtctattcggacgacctcgtgctgtatgccgagtctcccaccatgccaaactatcactggtgggttgaacatctgaatttgatgctggggtttcagacggacccaaagaagacagcaataacagactcgccatcatttctaggctgtagaataataaatgggcgccagctagtccccaaccgtgacaggatcctcgcggccctcgcctatcacatgaaggcgagtaatgtttctgaatactatgcctcagcggctgcaatactcatggacagctgtgcttgtttggagtatgatcctgaatggtttgaagaacttgtagttggaatagcgcagtgcgcccgcaaggacggctacagttttcccggcacgccgttcttcatgtccatgtgggaaaaactcaggtccaattatgaggggaagaagtcgagagtgtgcgggtactgcggggccccggccccgtacgctactgcctgtggcctcgacgtctgcatttaccacacccacttccaccagcattgtccagtcacaatctggtgtggccatccagcgggttctggttcttgtagtgagtgcaaatcccctgtagggaaaggcacaagccctttagacgaggtgctggaacaagtcccgtataagcccccacggaccgttatcatgcatgtggagcagggtctcaccccccttgatccaggtagataccaaactcgccgcggactagtctctgtcaggcgtggaattaggggaaatgaagttgaactaccagacggtgattatgctagcaccgccttgctccctacctgcaaagagatcaacatggtcgctgtcgcttccaatgtactgcgcagcaggttcatcatcggcccacccggtgctgggaaaacatactggctccttcaacaggtccaggatggtgatgttatttacacaccaactcaccagaccatgcttgacatgattagggctttggggacgtgccggttcaacgtcccggcaggcacaacgctgcaattccccgtcccctcccgcaccggtccgtgggttcgcatcctagccggcggttggtgtcctggcaagaattccttcctagatgaagcagcgtattgcaatcaccttgatgttttgaggcttcttagtaaaactaccctcacctgtctaggagacttcaagcaactccacccagtgggttttgattctcattgctatgtttttgacatcatgcctcaaactcaactgaagaccatctggaggtttggacagaatatctgtgatgccattcagccagattacagggacaaactcatgtccatggtcaacacaacccgtgtgacctacgtggaaaaacctgtcaggtatgggcaggtcctcaccccctaccacagggaccgagaggacgacgccatcactattgactccagtcaaggcgccacattcgatgtggttacattgcatttgcccactaatgattcactcaacaggcaaagagcccttgttgccatcaccagggcaagacacgctatctttgtgtatgacccacacaggcagctgcagggcttgtttgatcttcctgcaaaaggcacacccgtcaacctcgcagtgcaccgcgacgggcagctgatcgtgctggatagaaataacaaagaatgcacggtcgctcaggctctaggcaacggggataaatttagggccacagataagcgtgttgtagattctctccgcgccatttgtgctgatctagaagggtcgagctctccgctccccaaggtcgcacacaacttgggattttatttctcacctgatttaacacagtttgctaaactcccagtagaacttgcacctcactggcccgtggtgacaacccagaacaatgaaaagtggccagatcggctggttgccagccttcgccctatccataaatacagccgcgcgtgcatcggtgccggctatatggtgggcccttcggtgtttctaggcactcctggggtcgtgtcatactatctcacaaaatttgttaagggcgaggctcaattgcttccggagacggttttcagcaccggccgaattgaggtagactgccgggaatatcttgatgatcgggagcgagaagttgctgcgtccctcccacacgctttcattggcgacgtcaaaggcactaccgttggaggatgtcatcatgtcacctccagatacctcccacgcgtccttcccaaggaatcagttgcggtagtcggggtttcaagccccggaaaagccgcgaaagcattgtgcacactgacagatgtgtacctcccagatcttgacgcctatctccacccggagacccagtccaagtgctggaaaatgatgttggacttcaaagaagttcgactaatggtctggaaagacaaaacagcctatttccaacttgaaggtcgctatttcacctggtatcagcttgccagctatgcctcgtacatccgtgttcctgtcaactctacggtgtacttggacccctgcatgggccccgccctttgcaacaggagagtcgtcgggtccacccactggggggctgacctcgcggtcaccccttatgattacggcgctaaaattatcctgtctagcgcgtaccatggtgaaatgccccccggatacaaaattctggcgtgcgcggagttctcgttggatgacccagttaagtacaaacatacctgggggtttgaatcggatacagcgtatctgtatgagttcaccggaaacggtgaggactgggaggattacaatgatgcgtttcgtgcgcgccaggaagggaaaatttataaggccactgccaccagcttgaagttttattttcccccgggccctgtcattgaaccaactttaggcctgaattgaaatgaaatggggtccatgcaaagccttttttacaaaattggccaactttttgtggatgctttcacggagttcttggtgtccattgttgatatcactatatttttggccattttgtttggcttcaccatcgccggttggctggtggtcttttgcatcagattggtttgctccgcgatactccgtacgcgctctgccattcactctgagcaattacagaagatcttatgaggcctttctttcccagtgccaagtggacattcccacctggggaactaaacatcctttggggatgctttggcaccataaggtgtcaaccctgattgatgaaatggtgtcgcgtcgaatgtaccgcatcatggaaaaagcagggcaggctgcctggaaacaggtggtgagcgaggctacgctgtctcgcattagtagtttggatgtggtggctcattttcagcatctagccgccattgaagccgagacctgtaaatatttggcctcccggctgcccatgctacacaacctgcgcatgacaggttcaaatgtaaccatagtgtataatagcactttgaatcaggtgtttgctatttttccaacccctggttcccggccaaagcttaatgattttcagcaatggttaatagctgtacattcctccatattttcctctgttgcaacttcttgtactctttttgttgtgctgtggttgcgggttccaatactacgtactgcttttggtttccgctggttaggggcaatttttctttcgaactcacagtgaattacacggtgtgtccaccttgcctcacccggcaagcagccgcagagatctacgaacccggtaggtctctttggtgcaggatagggtatgaccgatgtgaggaggatgatcatgacgagctagggtttatggtaccgcctggcctctccagcgaaggccacttgactagtgtttacgcctggttggcgttcttgtccttcagctacacggcccagttccatcccgagatattcgggatagggaatgtgagtcgagtttatgttgacgtcaaacatcaactcatctgcgccgaacatgacgggcagaacaccaccttgcctcgtcatgacaacatttcagccgtgtttcagacctattaccaacatcaagtcgacggcggcaattggtttcacctagaatggcttcgtcccttcttttcctcgtggttggttttaaatgtctcttggtttctcaggcgttcgcctgcaaaccatgtttcagttcgagtcttgcagatattaagaccaacaccaccgcagcggcaagctttgctgtcctccaagacatcagttgccttaggcatcgcgactcggcctctgaggcgattcgcaaaatccctcagtgccgtacggcgatagggacacccgtgtatgttaccatcacagccaatgtgacagatgagaattatttacattcttctgatctcctcatgctttcttcttgccttttctatgcttctgagatgagtgaaaagggatttaaggtggtatttggcaatgtgtcaggcatcgtggctgtgtgtgtcaattttaccagctacgtccaacatgtcaaggagtttacccaacgctccctggtggtcgaccatgtgcggttgctccatttcatgacacctgagaccatgaggtgggcaactgttttagcctgtctttttgccattctgttggcaatttgaatgtttaagtatgttggagaaatgcttgaccgcgggctgttactcgcaattgctttctttgtggtgtatcgtgccgttctgttttgctgtgctcgtcaacgccagcaacgacagcagctcccatctacagctgatttacaacttgacgctatgtgagctgaatggcacagattggctagctaacaaatttgattgggcagtggagagttttgtcatctttcccgttttgactcacattgtctcctatggtgccctcactactagccatttccttgacacagtcgctttagtcactgtgtctaccgccgggtttgttcacgggcggtatgtcctaagtagcatctacgcggtctgtgccctggctgcgttgacttgcttcgtcattaggtttgcaaagaattgcatgtcctggcgctacgcgtgtaccagatataccaactttcttctggacactaagggcagactctatcgttggcggtcgcctgtcatcatagagaaaaggggcaaagttgaggtcgaaggtcatctgatcgacctcaaaagagttgtgcttgatggttccgtggcaacccctataaccagagtttcagcggaacaatggggtcgtccttagatgacttctgtcatgatagcacggctccacaaaaggtgcttttggcgttttctattacctacacgccagtgatgatatatgccctaaaggtgagtcgcggccgactgctagggcttctgcaccttttgatcttcctgaattgtgctttcaccttcgggtacatgactttcgcgcactttcagagtacaaataaggtcgcgctcactatgggagcagtagttgcactcctttggggggtgtactcagccatagaaacctggaaattcatcacctccagatgccgtttgtgcttgctaggccgcaagtacattctggcccctgcccaccacgttgaaagtgccgcaggctttcatccgattgcggcaaatgataaccacgcatttgtcgtccggcgtcccggctccactacggtcaacggcacattggtgcccgggttaaaaagcctcgtgttgggtggcagaaaagctgttaaacagggagtggtaaaccttgtcaaatatgccaaataacaacggcaagcagcagaatagaaagaagggggatggccagccagtcaatcagctgtgccagatgctgggtaagatcatcgctcagcaaaaccagtccagaggcaagggaccgggaaagaaaaataagaagaaaaacccggagaagccccattttcctctagcgactgaagatgatgtcagacatcactttacccctagtgagcggcaattgtgtctgtcgtcaatccagaccgcctttaatcaaggcgctgggacttgcaccctgtcagattcagggaggataagttacactgtggagtttagtttgcctacgcatcatactgtgcgcctgattcgcgtcacagcatcaccctcagcatgatgggctggcattcttgaggcatctcagtgtttgaattggaagaatgtgtggtgaatggcactgattgacattgtgcctctaagtcacctattcaattagggcgaccgtgtgggggtgagatttaattggcgagaaccatgcggccgaaattaaaaaaaaaaaaaaaaaaaa

SEQ ID NO: 96 - DNA, 15432 bp, Porcine reproductive and respiratory syndrome virus
tatgacgtataggtgttggctctatgccttggcatttgtattgtcaggagctgtgaccattggcacagcccaaaacttgcttcacagaaacacccttctgtgatagcctccttcaggggagcttagggtttgtccctagcaccttgcttccggagttgcactgctttacggtctctccacccctttaaccatgtctgggatacttgatcggtgcacgtgtacccccaatgccagggtgtttatggcggagggccaagtctactgcacacgatgcctcagtgcacggtctctccttcccctgaacctccaagtttctgagctcggggtgctaggcctattctacaggcccgaagagccactccggtggacgttgccacgtgcattccccactgttgagtgctcccccgccggggcctgctggctctctgcaatctttccaatcgcacgaatgaccagtggaaacctgaacttccaacaaagaatgatacgggtcgcagctgagctttacagagccggccagctcacccctgcagtcttgaaggctctacaagtttatgaacggggttgccgctggtaccccattgttggacctgcccctggagtggccgtttacgccaattccctacatgtgagtgataaacctttcccgggagcaactcacgtgttgaccaacctgccgctcccgcagagacccaagcctgaagacttttgcccctttgagtgtgctatggctactgtctatgacattggtcatgacgccgtcatgtatgtggccgaaaggaagatctcctgggcccctcgtggcggggatgaagtgaaatttgaagctgtccccggggagttgaggttgattgcgaaccggctccgcacctccttcccgccccaccacacagtggacatgtctaagttcgccttcacagcccctgggtgtggtgtttctatgcgggttgaacgccaacacggctgccttcccgctgacactgtccctgaaggcaactgctggtggagcttgtttgactcgcttccactggaagttcagaacaaagaaattcgccatgctaaccaatttggctaccagaccaagcatggtgtctctggcaagtacctacagcggaggctgcaagttaatggtctccgagcagtaactgacctaaacggacctatcgtcgtacagtacttctccgttaaggagagttggatccgccatttgaaactggcgggagaacccagctactctgggtttgaggacctcctcagaataagggttgagcctaacacgtcgccattggctgacaaggaagaaaaaattttccggtttggcagtcacaagtggtacggcgctggaaagagagcaagaaaagcacgctcttgtgcgactgccacagtcgctggccgcgctttgtccgttcgtgaaactcggcaggccaaggagcacgaggttgccggcgcctacaaggctgagcacctcaaacactactccccgcctgccgaagggaattgtggttggcactgcatttccgccatcgccaaccggatggtgaattccaaatttgaaaccacccttcccgaaagagtgagacctccagatgactgggctactgacgaggatcttgtgaatgccatccaaatcctcagactccctgcggccttagacaggaacggtgcttgtactagcgccaagtacgtacttaagctggaaggtgagcattggactgtcactgtggcccctgggatgtccccttctttgctccctcttgaatgtgttcagggctgttgtgggcacaagggcggtcttggttccccagatgcagtcgaggtctccggatttgaccctgcctgccttgaccggctggctgaggtgatgcacctgcctagcagtgctatcccagccgctctggccgaaatgtctggcgattccgatcgttcggcttctccggtcaccaccgtgtggactgtttcgcagttctttgcccgtcacagcggagggaatcaccctgatcaagtgcgcttagggaaaattatcagcctttgtcaggtgattgaggactgctgctgttcccagaacaaaaccaaccgggtcaccccggaggaggtcgcagcaaagattgacctgtacctccgtggtgcaacaaatcttgaagaatgcttggccaggcttgagaaagcgcgcccgccacgcgtaatcgacaccttctttgattgggatgttgtgctccctggggttgaggcggcaacccagacgatcaagctgccccaggtcaaccagtgtcgtgctctggtccctgttgtgactcaaaagtccttggacgacaactcggtccccctgaccgccttttcactggctaactactactaccgtgcgcaaggtgacgaagttcgtcaccgtgaaagactaaccgccgtgctctccaagttggaaaaggttgttcgagaagaatatgggctcatgccaaccgagcctggtccacggcccacactgccacgcgggctcgacgaactcaaagaccagatggaggaggacttgctgaagctggctaacgcccagacgacttcggacatgatggcctgggcagtcgagcaggttgacctaaaaacttgggtcaagaactacccgcggtggacaccaccaccccctccgccaaaagttcagcctcgaaaaacgaagcctgtcaagagcttgccggagagaaagcctgtccccgccccgcgcaggaaggttgggtccgattgtggcagcccggtttcattaggcggcgatgtctctaacagttgggaagatttggctgttagtagcccctttgatctcccgaccccacctgagccggcaacaccttcaagtgagctggtgattgtgtcctcaccgcaatgcatcttcaggccggcgacacccttgagtgagccggctccaattcccgcacctcgcggaactgtgtctcgaccggtgacacccttgagtgagccgatccctgtgcccgcaccgcggcgtaagtttcagcaggtgaaaagattgagttcggcggcggcaatcccaccgtaccagaacgagcccctggatttgtctgcttcctcacagactgaatatgaggcctctcccccagcaccgccgcagagcgggggcgttctgggagtagaggggcatgaagctgaggaaaccctgagtgaaatctcggacatgtcgggtaacattaaacctgcgtccgtgtcatcaagcagctccttgtccagcgtgagaatcacacgcccaaaatactcagctcaagccatcatcgactcgggcgggccctgcagtgggcatctccaagaggtaaaggaaacatgccttagtgtcatgcgcgaggcatgtgatgcgactaagcttgatgaccctgctacgcaggaatggctttctcgcatgtgggatcgggtggacatgctgacttggcgcaacacgtctgtttaccaggcgatttgcaccttagatggcaggttaaagttcctcccaaaaatgatactcgagacaccgccgccctatccgtgtgagtttgtgatgatgcctcacacgcctgcaccttccgtaggtgcggagagcgaccttaccattggctcagttgctactgaagatgttccacgcatcctcgagaaaatagaaaatgtcggcgagatggccaaccagggacccttggccttctccgaggataaaccggtagatgaccaacttgtcaacgacccccggatatcgtcgcggaggcctgacgagagcacatcagctccgtccgcaggcacaggtggcgccggctcttttaccgatttgccgccttcagatggcgcggatgcggacgggggggggccgtttcggacggcaaaaagaaaagctgaaaggctctttgaccaactgagccgtcaggtattcgacctagtgagtcatttgcctgttttcttctcacgccttttctaccctggcggtggttattctccgggtgattggggttttgcagcttttactctattgtgcctctttttatgttacagttacccagcctttggtattgctcccctcttgggtgtgttttctgggtcttctcggcgcgttcgaatgggggtttttggctgctggttggcttttgctgttggtctgttcaagcctgtgtccgacccagtcggcgctgcttgtgagtttgactcgccagagtgtagaaacatccttcattcttttgagcttctcaaaccttgggaccctgttcgcagccttgttgtgggccccgtcggtctcggtcttgccattcttggcaggttactgggcggggcacgctgcatctggcactttttgcttaggcttggcattgttgcagactgtatcttggctggagcttacgtgctttctcaaggtaggtgtaaaaagtgctggggatcttgtataagaactgctcctaatgaggtcgcttttaacgtgtttcctttcacacgtgcgaccaggtcgtcacttatcgacctgtgcgatcggttttgtgcgccaaaaggaatggaccccatttttctcgccactgggtggcgcgggtgctgggccggccgaagccccattgagcaaccctctgaaaaacccatcgcgtttgcccaattggatgaaaagaagattacggctaggactgtggtcgcccagccttatgaccccaaccaagccgtaaagtgcttgcgggtattgcaggcgggtggggcgatggtggctaaggcggtcccaaaagtggttaaggtttccgctgttccattccgagctcccttctttcccactggagtgaaagttgaccctgattgcagggtcgtggttgaccctgacactttcactgcagctctccggtctggctactccaccacaaacctcgtccttggtgtaggggactttgcccagctaaatggattaaaaatcaggcaaatttccaagccttcagggggaggcccacatctcatggctgccctgcatgttgcctgctcgatggctctgcacatgcttgctgggatttatgtgactgcggtgggttcttgcggcaccggcaccaacgacccgtggtgcgctaacccgtttgccgtccctggctacggacctggctctctctgtacgtccagattgtgcatttcccaacacggccttaccctgcccttgtcagcacttgtggcgggattcggtattcaagaaattgccttggtcgttttgatttttgtttccatcggaggcatggctcataggttgagctgtaaggctgacatgctgtgtgttttgcttgcaattgccagctatgtttgggtacctcttacctggttgctttgtgtgtttccttgctggttgcgctgtttttctttgcaccccctcaccatcctatggttggtgtttttcttgatttctgtgaatatgccttcaggaatcttggccatggtgttgttggtttctctttggcttcttggtcgttatactaatgttgctggccttgtcaccccctacgacattcatcattacaccagtggcccccgcggtgttgccgccttggctaccgcaccagatgggacctacttggccgctgtccgccgcgctgcgttgactggccgcaccatgctgtttaccccgtcccagcttgggtctcttcttgagggtgctttcagaactcgaaagccctcactgaacaccgtcaatgtgatcgggtcctccatgggctctggcggggtgtttaccatcgacgggaaagtcaagtgcgtaactgccgcacatgtccttacgggcaattcagctcgggtttccggggtcggcttcaatcaaatgcttgactttgacgtaaagggagatttcgctatcgctgattgcccgaattggcaaggggctgcccccaagacccaattctgcacggatggatggactggccgtgcctattggctaacatcctctggcgtcgaacccggcgtcattggaaaaggattcgccttctgcttcaccgcatgtggcgattccgggtccccagtgatcaccgaggccggtgagcttgtcggcgttcacacgggatcgaataaacaaggggggggcattgttacgcgcccctcaggccagttttgtaatgtggcacccatcaagctaagcgaattaagtgaattctttgctgggcctaaggtcccgctcggtgatgtgaaggtcggcagccacataattaaagacataagcgaggtgccttcagatctttgtgccttgcttgctgccaaacctgaactggaaggaggcctctccaccgtccaacttctttgtgtgttttttctcctgtggagaatgatgggacatgcctggacgcccttggttgctgtgagtttctttattttgaatgaggttctccctgccgtcctggtccggagtgttttctcctttggaatgtttgtgctatcctggctcacgccatggtctgcgcaagttctgatgatcaggcttctgacagcagctcttaacaggaacagatggtcacttgcctttttcagcctcggtgcagtgaccggttttgtcgcagatcttgcggccactcaggggcatccgttgcaggcagtgatgaatttgagcacctatgcattcctgcctcggatgatggttgtgacctcaccagtcccagtgatcacgtgtggtgtcgtgcacctacttgccatcattttgtacttgtttaagtaccgtggcctgcaccatatccttgttggcgatggagtgttctctgcggctttcttcttgagatactttgccgagggaaagttgagggaaggggtgtcgcaatcctgcggaatgaatcatgagtctctgactggtgccctcgctatgagactcaatgacgaggacttggatttccttatgaaatggactgattttaagtgctttgtttctgcgtccaacatgaggaatgcagcgggtcaatttatcgaggctgcctatgctaaagcacttagagtagaactggcccagttggtacaggttgataaagttcgaggtactttggccaaacttgaagcttttgctgataccgtggctcctcaactctcgcccggtgacattgttgtcgctctcggccacacgcctgttggcagtatcttcgacctaaaggttggtagcaccaagcataccctccaagccattgagaccagagtccttgctgggtccaaaatgaccgtggcgcgcgtcgtcgacccgacccccacgcccccacccgcacccgtgcccatccccctcccaccgaaagttctggagaatggccccaacgcttggggggatgaggaccgtttgaataagaagaagaggcgcaggatggaagccctcggcatctatgttatgggcgggaaaaagtaccagaaattttgggacaagaattccggtgatgtgttttatgaggaggtccataataacacagatgagtgggagtgtctcagagttggcgaccctgccgactttgaccctgagaagggaactctgtgtggacatgtcaccattgaaaataaggcttaccatgtttacacctccccatctggtaagaagttcttggtccccgtcaacccagagaatggaagagttcaatgggaagctgcaaagctttccgtggagcaggccctaggtatgatgaatgtcgacggcgaactgactgccaaagaactggagaaactgaaaagaataattgacaaactccagggcctgactaaggagcagtgtttaaactgctagccgccagcgacttgacccgctgtggtcgcggcggcttggttgttactgaaacagcggtaaaaatagtcaaatttcacaaccggaccttcaccctgggacctgtgaatttaaaagtggccagtgaggttgagctaaaagacgcggttgagcacaaccaacacccggttgcgagaccgatcgatggtggagttgtgctcttgcgttccgcggttccttcgcttatagacgtcttgatctccggtgctgatgcatctcccaagttacttgcccatcacgggccgggaaacactgggatcgatggcacgctctgggattttgagtccgaagccactaaagaggaagtcgcactcagtgcgcaaataatacaggcttgtgacattaggcgcggcgacgctcctgaaattggtctcccttacaagctgtaccctgttaggggtaaccctgagcgggtgaaaggagttctgcagaatacaaggtttggagacataccttacaaaacccccagtgacactggaagcccagtgcacgcggctgcctgccttacgcccaacgccactccggtgactgatgggcgctccgtcttggccacgaccatgccccccgggtttgagttatatgtaccgaccataccagcgtctgtccttgattaccttgactctaggcctgactgccctaaacagctgacagagcacggctgcgaagatgccgcactgaaagacctctctaaatatgacttgtccacccaaggctttgttttacctggagttcttcgccttgtgcggaaatacctgtttgcccatgtaggtaagtgcccacccgttcatcggccttctacttaccctgctaagaattctatggctggaataaatgggaacaggttcccaaccaaggacattcagagcgtccctgaaatcgacgttctgtgcgcacaggctgtgcgagaaaactggcaaactgtcaccccttgtactcttaagaaacagtattgcgggaagaagaagactaggaccatactcggcaccaataacttcatcgcactagcccaccgagcagtgttgagtggtgttacccagggcttcatgaaaaaggcgtttaactcgcccatcgccctcggaaagaacaagtttaaggagctacagactccggtcctgggcaggtgccttgaagctgatctcgcatcctgcgatcgatccacgcctgcaattgtccgctggtttgccgccaaccttctttatgaacttgcctgtgctgaagagcatctaccgtcgtacgtgctgaactgctgccacgacttactggtcacgcagtccggcgcagtgactaagagaggtggcctgtcgtctggcgacccgatcacctctgtgtctaacaccatttatagtttggtgatctatgcacagcatatggtgcttagttacttcaaaagtggtcacccccatggccttctgttcttacaagaccagctaaagtttgaggacatgctcaaggttcaacccctgatcgtctattcggacgacctcgtgctgtatgccgagtctcccaccatgccaaactatcactggtgggttgaacatctgaatttgatgctggggtttcagacggacccaaagaagacagcaataacagactcgccatcatttctaggctgtagaataataaatgggcgccagctagtccccaaccgtgacaggatcctcgcggccctcgcctatcacatgaaggcgagtaatgtttctgaatactatgcctcagcggctgcaatactcatggacagctgtgcttgtttggagtatgatcctgaatggtttgaagaacttgtagttggaatagcgcagtgcgcccgcaaggacggctacagttttcccggcacgccgttcttcatgtccatgtgggaaaaactcaggtccaattatgaggggaagaagtcgagagtgtgcgggtactgcggggccccggccccgtacgctactgcctgtggcctcgacgtctgcatttaccacacccacttccaccagcattgtccagtcacaatctggtgtggccatccagcgggttctggttcttgtagtgagtgcaaatcccctgtagggaaaggcacaagccctttagacgaggtgctggaacaagtcccgtataagcccccacggaccgttatcatgcatgtggagcagggtctcaccccccttgatccaggtagataccaaactcgccgcggactagtctctgtcaggcgtggaattaggggaaatgaagttgaactaccagacggtgattatgctagcaccgccttgctccctacctgcaaagagatcaacatggtcgctgtcgcttccaatgtactgcgcagcaggttcatcatcggcccacccggtgctgggaaaacatactggctccttcaacaggtccaggatggtgatgttatttacacaccaactcaccagaccatgcttgacatgattagggctttggggacgtgccggttcaacgtcccggcaggcacaacgctgcaattccccgtcccctcccgcaccggtccgtgggttcgcatcctagccggcggttggtgtcctggcaagaattccttcctagatgaagcagcgtattgcaatcaccttgatgttttgaggcttcttagtaaaactaccctcacctgtctaggagacttcaagcaactccacccagtgggttttgattctcattgctatgtttttgacatcatgcctcaaactcaactgaagaccatctggaggtttggacagaatatctgtgatgccattcagccagattacagggacaaactcatgtccatggtcaacacaacccgtgtgacctacgtggaaaaacctgtcaggtatgggcaggtcctcaccccctaccacagggaccgagaggacgacgccatcactattgactccagtcaaggcgccacattcgatgtggttacattgcatttgcccactaatgattcactcaacaggcaaagagcccttgttgccatcaccagggcaagacacgctatctttgtgtatgacccacacaggcagctgcagggcttgtttgatcttcctgcaaaaggcacacccgtcaacctcgcagtgcaccgcgacgggcagctgatcgtgctggatagaaataacaaagaatgcacggtcgctcaggctctaggcaacggggataaatttagggccacagataagcgtgttgtagattctctccgcgccatttgtgctgatctagaagggtcgagctctccgctccccaaggtcgcacacaacttgggattttatttctcacctgatttaacacagtttgctaaactcccagtagaacttgcacctcactggcccgtggtgacaacccagaacaatgaaaagtggccagatcggctggttgccagccttcgccctatccataaatacagccgcgcgtgcatcggtgccggctatatggtgggcccttcggtgtttctaggcactcctggggtcgtgtcatactatctcacaaaatttgttaagggcgaggctcaattgcttccggagacggttttcagcaccggccgaattgaggtagactgccgggaatatcttgatgatcgggagcgagaagttgctgcgtccctcccacacgctttcattggcgacgtcaaaggcactaccgttggaggatgtcatcatgtcacctccagatacctcccacgcgtccttcccaaggaatcagttgcggtagtcggggtttcaagccccggaaaagccgcgaaagcattgtgcacactgacagatgtgtacctcccagatcttgacgcctatctccacccggagacccagtccaagtgctggaaaatgatgttggacttcaaagaagttcgactaatggtctggaaagacaaaacagcctatttccaacttgaaggtcgctatttcacctggtatcagcttgccagctatgcctcgtacatccgtgttcctgtcaactctacggtgtacttggacccctgcatgggccccgccctttgcaacaggagagtcgtcgggtccacccactggggggctgacctcgcggtcaccccttatgattacggcgctaaaattatcctgtctagcgcgtaccatggtgaaatgccccccggatacaaaattctggcgtgcgcggagttctcgttggatgacccagttaagtacaaacatacctgggggtttgaatcggatacagcgtatctgtatgagttcaccggaaacggtgaggactgggaggattacaatgatgcgtttcgtgcgcgccaggaagggaaaatttataaggccactgccaccagcttgaagttttattttcccccgggccctgtcattgaaccaactttaggcctgaattgaaatgaaatggggtccatgcaaagccttttttacaaaattggccaactttttgtggatgctttcacggagttcttggtgtccattgttgatatcactatatttttggccattttgtttggcttcaccatcgccggttggctggtggtcttttgcatcagattggtttgctccgcgatactccgtacgcgctctgccattcactctgagcaattacagaagatcttatgaggcctttctttcccagtgccaagtggacattcccacctggggaactaaacatcctttggggatgctttggcaccataaggtgtcaaccctgattgatgaaatggtgtcgcgtcgaatgtaccgcatcatggaaaaagcagggcaggctgcctggaaacaggtggtgagcgaggctacgctgtctcgcattagtagtttggatgtggtggctcattttcagcatctagccgccattgaagccgagacctgtaaatatttggcctcccggctgcccatgctacacaacctgcgcatgacaggttcaaatgtaaccatagtgtataatagcactttgaatcaggtgtttgctatttttccaacccctggttcccggccaaagcttaatgattttcagcaatggttaatagctgtacattcctccatattttcctctgttgcaacttcttgtactctttttgttgtgctgtggttgcgggttccaatactacgtactgcttttggtttccgctggttaggggcaatttttctttcgaactcacagtgaattacacggtgtgtccaccttgcctcacccggcaagcagccgcagagatctacgaacccggtaggtctctttggtgcaggatagggtatgaccgatgtgaggaggatgatcatgacgagctagggtttatggtaccgcctggcctctccagcgaaggccacttgactagtgtttacgcctggttggcgttcttgtccttcagctacacggcccagttccatcccgagatattcgggatagggaatgtgagtcgagtttatgttgacgtcaaacatcaactcatctgcgccgaacatgacgggcagaacaccaccttgcctcgtcatgacaacatttcagccgtgtttcagacctattaccaacatcaagtcgacggcggcaattggtttcacctagaatggcttcgtcccttcttttcctcgtggttggttttaaatgtctcttggtttctcaggcgttcgcctgcaaaccatgtttcagttcgagtcttgcagatattaagaccaacaccaccgcagcggcaagctttgctgtcctccaagacatcagttgccttaggcatcgcgactcggcctctgaggcgattcgcaaaatccctcagtgccgtacggcgatagggacacccgtgtatgttaccatcacagccaatgtgacagatgagaattatttacattcttctgatctcctcatgctttcttcttgccttttctatgcttctgagatgagtgaaaagggatttaaggtggtatttggcaatgtgtcaggcatcgtggctgtgtgtgtcaattttaccagctacgtccaacatgtcaaggagtttacccaacgctccctggtggtcgaccatgtgcggttgctccatttcatgacacctgagaccatgaggtgggcaactgttttagcctgtctttttgccattctgttggcaatttgaatgtttaagtatgttggagaaatgcttgaccgcgggctgttactcgcaattgctttctttgtggtgtatcgtgccgttctgttttgctgtgctcgtcaacgccagcaacgacagcagctcccatctacagctgatttacaacttgacgctatgtgagctgaatggcacagattggctagctaacaaatttgattgggcagtggagagttttgtcatctttcccgttttgactcacattgtctcctatggtgccctcactactagccatttccttgacacagtcgctttagtcactgtgtctaccgccgggtttgttcacgggcggtatgtcctaagtagcatctacgcggtctgtgccctggctgcgttgacttgcttcgtcattaggtttgcaaagaattgcatgtcctggcgctacgcgtgtaccagatataccaactttcttctggacactaagggcagactctatcgttggcggtcgcctgtcatcatagagaaaaggggcaaagttgaggtcgaaggtcatctgatcgacctcaaaagagttgtgcttgatggttccgtggcaacccctataaccagagtttcagcggaacaatggggtcgtccttagatgacttctgtcatgatagcacggctccacaaaaggtgcttttggcgttttctattacctacacgccagtgatgatatatgccctaaaggtgagtcgcggccgactgctagggcttctgcaccttttgatcttcctgaattgtgctttcaccttcgggtacatgactttcgcgcactttcagagtacaaataaggtcgcgctcactatgggagcagtagttgcactcctttggggggtgtactcagccatagaaacctggaaattcatcacctccagatgccgtttgtgcttgctaggccgcaagtacattctggcccctgcccaccacgttgaaagtgccgcaggctttcatccgattgcggcaaatgataaccacgcatttgtcgtccggcgtcccggctccactacggtcaacggcacattggtgcccgggttaaaaagcctcgtgttgggtggcagaaaagctgttaaacagggagtggtaaaccttgtcaaatatgccaaataacaacggcaagcagcagaatagaaagaagggggatggccagccagtcaatcagctgtgccagatgctgggtaagatcatcgctcagcaaaaccagtccagaggcaagggaccgggaaagaaaaataagaagaaaaacccggagaagccccattttcctctagcgactgaagatgatgtcagacatcactttacccctagtgagcggcaattgtgtctgtcgtcaatccagaccgcctttaatcaaggcgctgggacttgcaccctgtcagattcagggaggataagttacactgtggagtttagtttgcctacgcatcatactgtgcgcctgattcgcgtcacagcatcaccctcagcatgatgggctggcattcttgaggcatctcagtgtttgaattggaagaatgtgtggtgaatggcactgattgacattgtgcctctaagtcacctattcaattagggcgaccgtgtgggggtgagatttaattggcgagaaccatgcggccgaaattaaaaaaaaaaaaaaaaaaaa

SEQ ID NO: 97 - DNA, 15432 bp, Porcine reproductive and respiratory syndrome virus
tatgacgtataggtgttggctctatgccttggcatttgtattgtcaggagctgtgaccattggcacagcccaaaacttgcttcacagaaacacccttctgtgatagcctccttcaggggagcttagggtttgtccctagcaccttgcttccggagttgcactgctttacggtctctccacccctttaaccatgtctgggatacttgatcggtgcacgtgtacccccaatgccagggtgtttatggcggagggccaagtctactgcacacgatgcctcagtgcacggtctctccttcccctgaacctccaagtttctgagctcggggtgctaggcctattctacaggcccgaagagccactccggtggacgttgccacgtgcattccccactgttgagtgctcccccgccggggcctgctggctctctgcaatctttccaatcgcacgaatgaccagtggaaacctgaacttccaacaaagaatgatacgggtcgcagctgagctttacagagccggccagctcacccctgcagtcttgaaggctctacaagtttatgaacggggttgccgctggtaccccattgttggacctgcccctggagtggccgtttacgccaattccctacatgtgagtgataaacctttcccgggagcaactcacgtgttgaccaacctgccgctcccgcagagacccaagcctgaagacttttgcccctttgagtgtgctatggctactgtctatgacattggtcatgacgccgtcatgtatgtggccgaaaggaagatctcctgggcccctcgtggcggggatgaagtgaaatttgaagctgtccccggggagttgaggttgattgcgaaccggctccgcacctccttcccgccccaccacacagtggacatgtctaagttcgccttcacagcccctgggtgtggtgtttctatgcgggttgaacgccaacacggctgccttcccgctgacactgtccctgaaggcaactgctggtggagcttgtttgactcgcttccactggaagttcagaacaaagaaattcgccatgctaaccaatttggctaccagaccaagcatggtgtctctggcgcgtacctacaggcgaggctgcaagttaatggtctccgagcagtaactgacctaaacggacctatcgtcgtacagtacttctccgttaaggagagttggatccgccatttgaaactggcgggagaacccagctactctgggtttgaggacctcctcagaataagggttgagcctaacacgtcgccattggctgacaaggaagaaaaaattttccggtttggcagtcacaagtggtacggcgctggaaagagagcaagaaaagcacgctcttgtgcgactgccacagtcgctggccgcgctttgtccgttcgtgaaactcggcaggccaaggagcacgaggttgccggcgcctacaaggctgagcacctcaaacactactccccgcctgccgaagggaattgtggttggcactgcatttccgccatcgccaaccggatggtgaattccaaatttgaaaccacccttcccgaaagagtgagacctccagatgactgggctactgacgaggatcttgtgaatgccatccaaatcctcagactccctgcggccttagacaggaacggtgcttgtactagcgccaagtacgtacttaagctggaaggtgagcattggactgtcactgtggcccctgggatgtccccttctttgctccctcttgaatgtgttcagggctgttgtgggcacaagggcggtcttggttccccagatgcagtcgaggtctccggatttgaccctgcctgccttgaccggctggctgaggtgatgcacctgcctagcagtgctatcccagccgctctggccgaaatgtctggcgattccgatcgttcggcttctccggtcaccaccgtgtggactgtttcgcagttctttgcccgtcacagcggagggaatcaccctgatcaagtgcgcttagggaaaattatcagcctttgtcaggtgattgaggactgctgctgttcccagaacaaaaccaaccgggtcaccccggaggaggtcgcagcaaagattgacctgtacctccgtggtgcaacaaatcttgaagaatgcttggccaggcttgagaaagcgcgcccgccacgcgtaatcgacaccttctttgattgggatgttgtgctccctggggttgaggcggcaacccagacgatcaagctgccccaggtcaaccagtgtcgtgctctggtccctgttgtgactcaaaagtccttggacgacaactcggtccccctgaccgccttttcactggctaactactactaccgtgcgcaaggtgacgaagttcgtcaccgtgaaagactaaccgccgtgctctccaagttggaaaaggttgttcgagaagaatatgggctcatgccaaccgagcctggtccacggcccacactgccacgcgggctcgacgaactcaaagaccagatggaggaggacttgctgaagctggctaacgcccagacgacttcggacatgatggcctgggcagtcgagcaggttgacctaaaaacttgggtcaagaactacccgcggtggacaccaccaccccctccgccaaaagttcagcctcgaaaaacgaagcctgtcaagagcttgccggagagaaagcctgtccccgccccgcgcaggaaggttgggtccgattgtggcagcccggtttcattaggcggcgatgtctctaacagttgggaagatttggctgttagtagcccctttgatctcccgaccccacctgagccggcaacaccttcaagtgagctggtgattgtgtcctcaccgcaatgcatcttcaggccggcgacacccttgagtgagccggctccaattcccgcacctcgcggaactgtgtctcgaccggtgacacccttgagtgagccgatccctgtgcccgcaccgcggcgtaagtttcagcaggtgaaaagattgagttcggcggcggcaatcccaccgtaccagaacgagcccctggatttgtctgcttcctcacagactgaatatgaggcctctcccccagcaccgccgcagagcgggggcgttctgggagtagaggggcatgaagctgaggaaaccctgagtgaaatctcggacatgtcgggtaacattaaacctgcgtccgtgtcatcaagcagctccttgtccagcgtgagaatcacacgcccaaaatactcagctcaagccatcatcgactcgggcgggccctgcagtgggcatctccaagaggtaaaggaaacatgccttagtgtcatgcgcgaggcatgtgatgcgactaagcttgatgaccctgctacgcaggaatggctttctcgcatgtgggatcgggtggacatgctgacttggcgcaacacgtctgtttaccaggcgatttgcaccttagatggcaggttaaagttcctcccaaaaatgatactcgagacaccgccgccctatccgtgtgagtttgtgatgatgcctcacacgcctgcaccttccgtaggtgcggagagcgaccttaccattggctcagttgctactgaagatgttccacgcatcctcgagaaaatagaaaatgtcggcgagatggccaaccagggacccttggccttctccgaggataaaccggtagatgaccaacttgtcaacgacccccggatatcgtcgcggaggcctgacgagagcacatcagctccgtccgcaggcacaggtggcgccggctcttttaccgatttgccgccttcagatggcgcggatgcggacgggggggggccgtttcggacggcaaaaagaaaagctgaaaggctctttgaccaactgagccgtcaggtttttgacctcgtctcccatctccctgttttcttctcacgccttttctaccctggcggtggttattctccgggtgattggggttttgcagcttttactctattgtgcctctttttatgttacagttacccagcctttggtattgctcccctcttgggtgtgttttctgggtcttctcggcgcgttcgaatgggggtttttggctgctggttggcttttgctgttggtctgttcaagcctgtgtccgacccagtcggcgctgcttgtgagtttgactcgccagagtgtagaaacatccttcattcttttgagcttctcaaaccttgggaccctgttcgcagccttgttgtgggccccgtcggtctcggtcttgccattcttggcaggttactgggcggggcacgctgcatctggcactttttgcttaggcttggcattgttgcagactgtatcttggctggagcttacgtgctttctcaaggtaggtgtaaaaagtgctggggatcttgtataagaactgctcctaatgaggtcgcttttaacgtgtttcctttcacacgtgcgaccaggtcgtcacttatcgacctgtgcgatcggttttgtgcgccaaaaggaatggaccccatttttctcgccactgggtggcgcgggtgctgggccggccgaagccccattgagcaaccctctgaaaaacccatcgcgtttgcccaattggatgaaaagaagattacggctaggactgtggtcgcccagccttatgaccccaaccaagccgtaaagtgcttgcgggtattgcaggcgggtggggcgatggtggctaaggcggtcccaaaagtggttaaggtttccgctgttccattccgagctcccttctttcccactggagtgaaagttgaccctgattgcagggtcgtggttgaccctgacactttcactgcagctctccggtctggctactccaccacaaacctcgtccttggtgtaggggactttgcccagctaaatggattaaaaatcaggcaaatttccaagccttcagggggaggcccacatctcatggctgccctgcatgttgcctgctcgatggctctgcacatgcttgctgggatttatgtgactgcggtgggttcttgcggcaccggcaccaacgacccgtggtgcgctaacccgtttgccgtccctggctacggacctggctctctctgtacgtccagattgtgcatttcccaacacggccttaccctgcccttgtcagcacttgtggcgggattcggtattcaagaaattgccttggtcgttttgatttttgtttccatcggaggcatggctcataggttgagctgtaaggctgacatgctgtgtgttttgcttgcaattgccagctatgtttgggtacctcttacctggttgctttgtgtgtttccttgctggttgcgctgtttttctttgcaccccctcaccatcctatggttggtgtttttcttgatttctgtgaatatgccttcaggaatcttggccatggtgttgttggtttctctttggcttcttggtcgttatactaatgttgctggccttgtcaccccctacgacattcatcattacaccagtggcccccgcggtgttgccgccttggctaccgcaccagatgggacctacttggccgctgtccgccgcgctgcgttgactggccgcaccatgctgtttaccccgtcccagcttgggtctcttcttgagggtgctttcagaactcgaaagccctcactgaacaccgtcaatgtgatcgggtcctccatgggctctggcggggtgtttaccatcgacgggaaagtcaagtgcgtaactgccgcacatgtccttacgggcaattcagctcgggtttccggggtcggcttcaatcaaatgcttgactttgacgtaaagggagatttcgctatcgctgattgcccgaattggcaaggggctgcccccaagacccaattctgcacggatggatggactggccgtgcctattggctaacatcctctggcgtcgaacccggcgtcattggaaaaggattcgccttctgcttcaccgcatgtggcgattccgggtccccagtgatcaccgaggccggtgagcttgtcggcgttcacacgggatcgaataaacaaggggggggcattgttacgcgcccctcaggccagttttgtaatgtggcacccatcaagctaagcgaattaagtgaattctttgctgggcctaaggtcccgctcggtgatgtgaaggtcggcagccacataattaaagacataagcgaggtgccttcagatctttgtgccttgcttgctgccaaacctgaactggaaggaggcctctccaccgtccaacttctttgtgtgttttttctcctgtggagaatgatgggacatgcctggacgcccttggttgctgtgagtttctttattttgaatgaggttctccctgccgtcctggtccggagtgttttctcctttggaatgtttgtgctatcctggctcacgccatggtctgcgcaagttctgatgatcaggcttctgacagcagctcttaacaggaacagatggtcacttgcctttttcagcctcggtgcagtgaccggttttgtcgcagatcttgcggccactcaggggcatccgttgcaggcagtgatgaatttgagcacctatgcattcctgcctcggatgatggttgtgacctcaccagtcccagtgatcacgtgtggtgtcgtgcacctacttgccatcattttgtacttgtttaagtaccgtggcctgcaccatatccttgttggcgatggagtgttctctgcggctttcttcttgagatactttgccgagggaaagttgagggaaggggtgtcgcaatcctgcggaatgaatcatgagtctctgactggtgccctcgctatgagactcaatgacgaggacttggatttccttatgaaatggactgattttaagtgctttgtttctgcgtccaacatgaggaatgcagcgggtcaatttatcgaggctgcctatgctaaagcacttagagtagaactggcccagttggtacaggttgataaagttcgaggtactttggccaaacttgaagcttttgctgataccgtggctcctcaactctcgcccggtgacattgttgtcgctctcggccacacgcctgttggcagtatcttcgacctaaaggttggtagcaccaagcataccctccaagccattgagaccagagtccttgctgggtccaaaatgaccgtggcgcgcgtcgtcgacccgacccccacgcccccacccgcacccgtgcccatccccctcccaccgaaagttctggagaatggccccaacgcttggggggatgaggaccgtttgaataagaagaagaggcgcaggatggaagccctcggcatctatgttatgggcgggaaaaagtaccagaaattttgggacaagaattccggtgatgtgttttatgaggaggtccataataacacagatgagtgggagtgtctcagagttggcgaccctgccgactttgaccctgagaagggaactctgtgtggacatgtcaccattgaaaataaggcttaccatgtttacacctccccatctggtaagaagttcttggtccccgtcaacccagagaatggaagagttcaatgggaagctgcaaagctttccgtggagcaggccctaggtatgatgaatgtcgacggcgaactgactgccaaagaactggagaaactgaaaagaataattgacaaactccagggcctgactaaggagcagtgtttaaactgctagccgccagcgacttgacccgctgtggtcgcggcggcttggttgttactgaaacagcggtaaaaatagtcaaatttcacaaccggaccttcaccctgggacctgtgaatttaaaagtggccagtgaggttgagctaaaagacgcggttgagcacaaccaacacccggttgcgagaccgatcgatggtggagttgtgctcttgcgttccgcggttccttcgcttatagacgtcttgatctccggtgctgatgcatctcccaagttacttgcccatcacgggccgggaaacactgggatcgatggcacgctctgggattttgagtccgaagccactaaagaggaagtcgcactcagtgcgcaaataatacaggcttgtgacattaggcgcggcgacgctcctgaaattggtctcccttacaagctgtaccctgttaggggtaaccctgagcgggtgaaaggagttctgcagaatacaaggtttggagacataccttacaaaacccccagtgacactggaagcccagtgcacgcggctgcctgccttacgcccaacgccactccggtgactgatgggcgctccgtcttggccacgaccatgccccccgggtttgagttatatgtaccgaccataccagcgtctgtccttgattaccttgactctaggcctgactgccctaaacagctgacagagcacggctgcgaagatgccgcactgaaagacctctctaaatatgacttgtccacccaaggctttgttttacctggagttcttcgccttgtgcggaaatacctgtttgcccatgtaggtaagtgcccacccgttcatcggccttctacttaccctgctaagaattctatggctggaataaatgggaacaggttcccaaccaaggacattcagagcgtccctgaaatcgacgttctgtgcgcacaggctgtgcgagaaaactggcaaactgtcaccccttgtactcttaagaaacagtattgcgggaagaagaagactaggaccatactcggcaccaataacttcatcgcactagcccaccgagcagtgttgagtggtgttacccagggcttcatgaaaaaggcgtttaactcgcccatcgccctcggaaagaacaagtttaaggagctacagactccggtcctgggcaggtgccttgaagctgatctcgcatcctgcgatcgatccacgcctgcaattgtccgctggtttgccgccaaccttctttatgaacttgcctgtgctgaagagcatctaccgtcgtacgtgctgaactgctgccacgacttactggtcacgcagtccggcgcagtgactaagagaggtggcctgtcgtctggcgacccgatcacctctgtgtctaacaccatttatagtttggtgatctatgcacagcatatggtgcttagttacttcaaaagtggtcacccccatggccttctgttcttacaagaccagctaaagtttgaggacatgctcaaggttcaacccctgatcgtctattcggacgacctcgtgctgtatgccgagtctcccaccatgccaaactatcactggtgggttgaacatctgaatttgatgctggggtttcagacggacccaaagaagacagcaataacagactcgccatcatttctaggctgtagaataataaatgggcgccagctagtccccaaccgtgacaggatcctcgcggccctcgcctatcacatgaaggcgagtaatgtttctgaatactatgcctcagcggctgcaatactcatggacagctgtgcttgtttggagtatgatcctgaatggtttgaagaacttgtagttggaatagcgcagtgcgcccgcaaggacggctacagttttcccggcacgccgttcttcatgtccatgtgggaaaaactcaggtccaattatgaggggaagaagtcgagagtgtgcgggtactgcggggccccggccccgtacgctactgcctgtggcctcgacgtctgcatttaccacacccacttccaccagcattgtccagtcacaatctggtgtggccatccagcgggttctggttcttgtagtgagtgcaaatcccctgtagggaaaggcacaagccctttagacgaggtgctggaacaagtcccgtataagcccccacggaccgttatcatgcatgtggagcagggtctcaccccccttgatccaggtagataccaaactcgccgcggactagtctctgtcaggcgtggaattaggggaaatgaagttgaactaccagacggtgattatgctagcaccgccttgctccctacctgcaaagagatcaacatggtcgctgtcgcttccaatgtactgcgcagcaggttcatcatcggcccacccggtgctgggaaaacatactggctccttcaacaggtccaggatggtgatgttatttacacaccaactcaccagaccatgcttgacatgattagggctttggggacgtgccggttcaacgtcccggcaggcacaacgctgcaattccccgtcccctcccgcaccggtccgtgggttcgcatcctagccggcggttggtgtcctggcaagaattccttcctagatgaagcagcgtattgcaatcaccttgatgttttgaggcttcttagtaaaactaccctcacctgtctaggagacttcaagcaactccacccagtgggttttgattctcattgctatgtttttgacatcatgcctcaaactcaactgaagaccatctggaggtttggacagaatatctgtgatgccattcagccagattacagggacaaactcatgtccatggtcaacacaacccgtgtgacctacgtggaaaaacctgtcaggtatgggcaggtcctcaccccctaccacagggaccgagaggacgacgccatcactattgactccagtcaaggcgccacattcgatgtggttacattgcatttgcccactaatgattcactcaacaggcaaagagcccttgttgccatcaccagggcaagacacgctatctttgtgtatgacccacacaggcagctgcagggcttgtttgatcttcctgcaaaaggcacacccgtcaacctcgcagtgcaccgcgacgggcagctgatcgtgctggatagaaataacaaagaatgcacggtcgctcaggctctaggcaacggggataaatttagggccacagataagcgtgttgtagattctctccgcgccatttgtgctgatctagaagggtcgagctctccgctccccaaggtcgcacacaacttgggattttatttctcacctgatttaacacagtttgctaaactcccagtagaacttgcacctcactggcccgtggtgacaacccagaacaatgaaaagtggccagatcggctggttgccagccttcgccctatccataaatacagccgcgcgtgcatcggtgccggctatatggtgggcccttcggtgtttctaggcactcctggggtcgtgtcatactatctcacaaaatttgttaagggcgaggctcaattgcttccggagacggttttcagcaccggccgaattgaggtagactgccgggaatatcttgatgatcgggagcgagaagttgctgcgtccctcccacacgctttcattggcgacgtcaaaggcactaccgttggaggatgtcatcatgtcacctccagatacctcccacgcgtccttcccaaggaatcagttgcggtagtcggggtttcaagccccggaaaagccgcgaaagcattgtgcacactgacagatgtgtacctcccagatcttgacgcctatctccacccggagacccagtccaagtgctggaaaatgatgttggacttcaaagaagttcgactaatggtctggaaagacaaaacagcctatttccaacttgaaggtcgctatttcacctggtatcagcttgccagctatgcctcgtacatccgtgttcctgtcaactctacggtgtacttggacccctgcatgggccccgccctttgcaacaggagagtcgtcgggtccacccactggggggctgacctcgcggtcaccccttatgattacggcgctaaaattatcctgtctagcgcgtaccatggtgaaatgccccccggatacaaaattctggcgtgcgcggagttctcgttggatgacccagttaagtacaaacatacctgggggtttgaatcggatacagcgtatctgtatgagttcaccggaaacggtgaggactgggaggattacaatgatgcgtttcgtgcgcgccaggaagggaaaatttataaggccactgccaccagcttgaagttttattttcccccgggccctgtcattgaaccaactttaggcctgaattgaaatgaaatggggtccatgcaaagccttttttacaaaattggccaactttttgtggatgctttcacggagttcttggtgtccattgttgatatcactatatttttggccattttgtttggcttcaccatcgccggttggctggtggtcttttgcatcagattggtttgctccgcgatactccgtacgcgctctgccattcactctgagcaattacagaagatcttatgaggcctttctttcccagtgccaagtggacattcccacctggggaactaaacatcctttggggatgctttggcaccataaggtgtcaaccctgattgatgaaatggtgtcgcgtcgaatgtaccgcatcatggaaaaagcagggcaggctgcctggaaacaggtggtgagcgaggctacgctgtctcgcattagtagtttggatgtggtggctcattttcagcatctagccgccattgaagccgagacctgtaaatatttggcctcccggctgcccatgctacacaacctgcgcatgacaggttcaaatgtaaccatagtgtataatagcactttgaatcaggtgtttgctatttttccaacccctggttcccggccaaagcttaatgattttcagcaatggttaatagctgtacattcctccatattttcctctgttgcaacttcttgtactctttttgttgtgctgtggttgcgggttccaatactacgtactgcttttggtttccgctggttaggggcaatttttctttcgaactcacagtgaattacacggtgtgtccaccttgcctcacccggcaagcagccgcagagatctacgaacccggtaggtctctttggtgcaggatagggtatgaccgatgtgaggaggatgatcatgacgagctagggtttatggtaccgcctggcctctccagcgaaggccacttgactagtgtttacgcctggttggcgttcttgtccttcagctacacggcccagttccatcccgagatattcgggatagggaatgtgagtcgagtttatgttgacgtcaaacatcaactcatctgcgccgaacatgacgggcagaacaccaccttgcctcgtcatgacaacatttcagccgtgtttcagacctattaccaacatcaagtcgacggcggcaattggtttcacctagaatggcttcgtcccttcttttcctcgtggttggttttaaatgtctcttggtttctcaggcgttcgcctgcaaaccatgtttcagttcgagtcttgcagatattaagaccaacaccaccgcagcggcaagctttgctgtcctccaagacatcagttgccttaggcatcgcgactcggcctctgaggcgattcgcaaaatccctcagtgccgtacggcgatagggacacccgtgtatgttaccatcacagccaatgtgacagatgagaattatttacattcttctgatctcctcatgctttcttcttgccttttctatgcttctgagatgagtgaaaagggatttaaggtggtatttggcaatgtgtcaggcatcgtggctgtgtgtgtcaattttaccagctacgtccaacatgtcaaggagtttacccaacgctccctggtggtcgaccatgtgcggttgctccatttcatgacacctgagaccatgaggtgggcaactgttttagcctgtctttttgccattctgttggcaatttgaatgtttaagtatgttggagaaatgcttgaccgcgggctgttactcgcaattgctttctttgtggtgtatcgtgccgttctgttttgctgtgctcgtcaacgccagcaacgacagcagctcccatctacagctgatttacaacttgacgctatgtgagctgaatggcacagattggctagctaacaaatttgattgggcagtggagagttttgtcatctttcccgttttgactcacattgtctcctatggtgccctcactactagccatttccttgacacagtcgctttagtcactgtgtctaccgccgggtttgttcacgggcggtatgtcctaagtagcatctacgcggtctgtgccctggctgcgttgacttgcttcgtcattaggtttgcaaagaattgcatgtcctggcgctacgcgtgtaccagatataccaactttcttctggacactaagggcagactctatcgttggcggtcgcctgtcatcatagagaaaaggggcaaagttgaggtcgaaggtcatctgatcgacctcaaaagagttgtgcttgatggttccgtggcaacccctataaccagagtttcagcggaacaatggggtcgtccttagatgacttctgtcatgatagcacggctccacaaaaggtgcttttggcgttttctattacctacacgccagtgatgatatatgccctaaaggtgagtcgcggccgactgctagggcttctgcaccttttgatcttcctgaattgtgctttcaccttcgggtacatgactttcgcgcactttcagagtacaaataaggtcgcgctcactatgggagcagtagttgcactcctttggggggtgtactcagccatagaaacctggaaattcatcacctccagatgccgtttgtgcttgctaggccgcaagtacattctggcccctgcccaccacgttgaaagtgccgcaggctttcatccgattgcggcaaatgataaccacgcatttgtcgtccggcgtcccggctccactacggtcaacggcacattggtgcccgggttaaaaagcctcgtgttgggtggcagaaaagctgttaaacagggagtggtaaaccttgtcaaatatgccaaataacaacggcaagcagcagaatagaaagaagggggatggccagccagtcaatcagctgtgccagatgctgggtaagatcatcgctcagcaaaaccagtccagaggcaagggaccgggaaagaaaaataagaagaaaaacccggagaagccccattttcctctagcgactgaagatgatgtcagacatcactttacccctagtgagcggcaattgtgtctgtcgtcaatccagaccgcctttaatcaaggcgctgggacttgcaccctgtcagattcagggaggataagttacactgtggagtttagtttgcctacgcatcatactgtgcgcctgattcgcgtcacagcatcaccctcagcatgatgggctggcattcttgaggcatctcagtgtttgaattggaagaatgtgtggtgaatggcactgattgacattgtgcctctaagtcacctattcaattagggcgaccgtgtgggggtgagatttaattggcgagaaccatgcggccgaaattaaaaaaaaaaaaaaaaaaaa

SEQ ID NO: 98 - RNA, 48 nt, Porcine reproductive and respiratory syndrome virus; identical to SEQ ID NO: 28

SEQ ID NO: 99 - RNA, 50 nt, Porcine reproductive and respiratory syndrome virus
cgucagguguucuugaccucgucucccaucucccuguuuucuucucacgc

SEQ ID NO: 100 - RNA, 48 nt, Porcine reproductive and respiratory syndrome virus
cgucagguuuuuggccucgucucccaucucccuguuuucuucucacgc

SEQ ID NO: 101 - RNA, 48 nt, Porcine reproductive and respiratory syndrome virus
cgucagguuuuugaccuagugagucauuugccuguuuucuucucacgc

SEQ ID NO: 102 - RNA, 48 nt, Porcine reproductive and respiratory syndrome virus
cgucagguauucgaccuagugagucauuugccuguuuucuucucacgc

SEQ ID NO: 103 - RNA, 45 nt, Porcine reproductive and respiratory syndrome virus
  misc_feature (10)..(24): n is a, c, g, or u
guucgaaugnnnnnnnnnnnnnnnugguuggcuuuugcuguuggu

SEQ ID NO: 104 - RNA, 45 nt, Porcine reproductive and respiratory syndrome virus
  misc_feature (10)..(24): n is a, c, g, or u
gugagaaugnnnnnnnnnnnnnnnugguuagcuuuugcuguaggu

SEQ ID NO: 105 - RNA, 48 nt, Porcine reproductive and respiratory syndrome virus
aggcaggucucucaccuccggccccaccuccuccacuucuuacauggc

SEQ ID NO: 106 - RNA, 48 nt, Porcine reproductive and respiratory syndrome virus; identical to SEQ ID NO: 32

SEQ ID NO: 107 - RNA, 37 nt, Porcine reproductive and respiratory syndrome virus
cagcggguuuuuggcuuguacccccagcuccuuucca

SEQ ID NO: 108 - RNA, 48 nt, Porcine reproductive and respiratory syndrome virus
gggcggguuuuuggauugcuaccccacauccuugccuucuuucauugc

SEQ ID NO: 109 - RNA, 48 nt, Porcine reproductive and respiratory syndrome virus; identical to SEQ ID NO: 108

SEQ ID NO: 110 - RNA, 62 nt, Porcine reproductive and respiratory syndrome virus
agggguguuuuuggauugcuaccccacauccuugccuucuuucauugucaaagucguccugu

SEQ ID NO: 111 - RNA, 62 nt, Porcine reproductive and respiratory syndrome virus
agagguguuuuuggauugcuaccccacauccuugccuucuuucauugucaaagucguccugu

SEQ ID NO: 112 - protein, 84 aa, Porcine reproductive and respiratory syndrome virus
PADTVPEGNCWWRLLDSLPPEVQYKEIRHANQFGYQTKHGVPGKYLQRRLQVNGLRAVTDTHGPIVIQYFSVKESWIRHLKLVE

SEQ ID NO: 113 - protein, 84 aa, Porcine reproductive and respiratory syndrome virus
PADTVPEGNCWWRLFDSLPPEVQYKEIRHANQFGYQTKHGVPGKYLQRRLQVNGLRAVTDTHGPIVIQYFSVKESWIRHLKLVE

SEQ ID NO: 114 - protein, 84 aa, Porcine reproductive and respiratory syndrome virus; identical to SEQ ID NO: 113

SEQ ID NO: 115 - protein, 84 aa, Porcine reproductive and respiratory syndrome virus
PANTVPEGNCWWRLFDSLPLDVQNKEIRRANQFGYQTKHGVAGKYLQRRLQANGLRAVTDTDGPIVVQYFSVRESWIRHFRLAE

SEQ ID NO: 116 - protein, 84 aa, Porcine reproductive and respiratory syndrome virus; identical to SEQ ID NO: 115

SEQ ID NO: 117 - protein, 84 aa, Porcine reproductive and respiratory syndrome virus
PANTVPEGNCWWRLFDLLPLEVQNKEIRRANQFGYQTKHGVAGKYLQRRLQANGLRAVTDKDGPIVVQYFSVKESWIRHLRLTE

SEQ ID NO: 118 - protein, 84 aa, Porcine reproductive and respiratory syndrome virus
PADTVPEGNCWWRLFDLLPPEVQNKEIRYANQFGYQTKHGVPGKYLQRRLQVNGLRAVTDTHGPIVIQYFSVEESWIRHFRLAG

SEQ ID NO: 119 - protein, 84 aa, Porcine reproductive and respiratory syndrome virus; identical to SEQ ID NO: 118

SEQ ID NO: 120 - protein, 84 aa, Porcine reproductive and respiratory syndrome virus
PADTVPEGNCWWCLFDLLPPEVQNKEIRRANQFGYQTKHGVPGKYLQRRLQVNGLRAVTDTDGPIVVQYFSVRESWIRHFRLAE

SEQ ID NO: 121 - protein, 84 aa, Porcine reproductive and respiratory syndrome virus
PADTVPEGNCWWSLFDLLPLEVQNKEIRHANQFGYQTKHGVSGKYLQRRLQVNGLRAVTDLNGPIVVQYFFVKESWIRHLKLAG

SEQ ID NO: 122 - protein, 84 aa, Porcine reproductive and respiratory syndrome virus
PADTVPEGNCWWSLFDSLPLEVQNKEIRHANQFGYQTKHGVSGKYLQRRLQVNGLRAVTDLNGPIVVQYFSVKESWIRHLKLAG

SEQ ID NO: 123 - protein, 84 aa, Porcine reproductive and respiratory syndrome virus
PADTVPEGNCWWSLFDLLPLEVQNKEIRYANQFGYQTKHGVSGKYLQRRLQVNGLRAVTDLNGPIVVQYFSVKESWIRHLKLAG

SEQ ID NO: 124 - protein, 84 aa, Porcine reproductive and respiratory syndrome virus
PADTVPEGNCWWSLFDLLPLEVQNKEIRHANQFGYQTKHGVSGKYLQRRLQVNGLRAVTDLNGPIVVQYFSVKESWIRHLKLAG

SEQ ID NO: 125 - protein, 84 aa, Porcine reproductive and respiratory syndrome virus
PADTVPEGNCWWSLFNLLPLEVQNKEIRHAGQFGYQTKHGVSGKYLQRRLQVNGLRAVTDLNGPIVVQCFSVKESWIRHLKLAE

SEQ ID NO: 126 - protein, 84 aa, Porcine reproductive and respiratory syndrome virus; identical to SEQ ID NO: 125

SEQ ID NO: 127 - protein, 84 aa, Porcine reproductive and respiratory syndrome virus
PAGTVPDGNCWWSLFSSLPLEIQYKEIRHATQFGYQTKHGVAGKYLQRRLQVNGLRAVVDSNGPIVIQYFSVKESWIRHVKLAE

SEQ ID NO: 128 - protein, 85 aa, Porcine reproductive and respiratory syndrome virus
VQNPDVFDGKCWLSCFLGQSAEVRRHEEHLADALGYQTKWGVPGKYLQRRLQVRGIRAVVDPDGPIHVEALSCPRSWIRHLTFDD

SEQ ID NO: 129 - protein, 85 aa, Porcine reproductive and respiratory syndrome virus; identical to SEQ ID NO: 128

SEQ ID NO: 130 - protein, 85 aa, Porcine reproductive and respiratory syndrome virus
VQNPDVFDGKCWLSCFLGQSVEVRCHEEHLADAFGYQTKWGVHGKYLQRRLQVRGIRAVVDPDGPIHVEALSCPQSWIRHLTLDD

SEQ ID NO: 131 - protein, 85 aa, Porcine reproductive and respiratory syndrome virus
VQNPNVFDGKCWLTCFLGQSAEVCYHEEHLANALGYQTKWGVHGKYLQRRLQVRGMRAVVDPDGPIHVEALSCSQSWVRHLTLNN

SEQ ID NO: 132 - protein, 85 aa, Porcine reproductive and respiratory syndrome virus
VRNSNVFDGKCWLTCFLGQSVEVRCHEEHLANAFGYQTKWGVHGKYLQRRLQVRGIRAVVDPDGPIHVEALSCSQSWIRHLTLND

SEQ ID NO: 133 - protein, 85 aa, Porcine reproductive and respiratory syndrome virus
VQNPDVFDSRCWLSCFSGLPSEVRFHEEHLASAFGYQTKWGVHGKYLQRRLQVRGVRAVVDPDGPIHVEALSCPQSWIRHLTLND

SEQ ID NO: 134 - protein, 85 aa, Porcine reproductive and respiratory syndrome virus
AQGPDGFDGKCWLSCFLSLPAKVWRHEEHLASAYGYQTKWGVHGKYLQRRLQINGIRAVVDPDGPIHVEALSCPQSWIRHLTMED

SEQ ID NO: 135 - protein, 85 aa, Porcine reproductive and respiratory syndrome virus
AQSPYAFDSKCWLSCFLSLSTEVWRHEEFLASAFGYQTKWGVHGKYLQRRLQVRGLRAVVDPDGPIHVEALSCPQSWIRHLTLDD

SEQ ID NO: 136 - protein, 85 aa, Porcine reproductive and respiratory syndrome virus
AQNPDVFDSKCWLSCFYGLSTRVWRHEEYLADAFGYQTKWGVHGKYLQRRLQINGVRAVVDPDGPIHVEALSCPQSWIRHLTLDD

SEQ ID NO: 137 - protein, 85 aa, Porcine reproductive and respiratory syndrome virus
AQNPDGFNGKCWLSCFFDLSTEVWRHEEYLADTLGYQTKWGVHGKYLQRRLQINGVRAVVDPDGPIHVEALSCPQSWIRHLTLDD

SEQ ID NO: 138 - protein, 203 aa, Porcine reproductive and respiratory syndrome virus
ATVYDIGHDAVMYVAERKISWAPRGGDEVKFEAVPGELRLIANRLRTSFPPHHTVDMSKFAFTAPGCGVSMRVERQHGCLPADTVPEGNCWWSLFDSLPLEVQNKEIRHANQFGYQTKHGVSGKYLQRRLQVNGLRAVTDLNGPIVVQYFSVKESWIRHLKLAGEPSYSGFEDLLRIRVEPNTSPLADKEEKIFRFGSHKWYG

SEQ ID NO: 139 - protein, 205 aa, Porcine reproductive and respiratory syndrome virus
SDVYRWKKFVIFTDSSPNGRFRMMWTPESDDSAALEVLPPELERQVEILTRSFPAHHPINLADWELTESPENGFSFGTSHSCGHIVQNPNVFDGKCWLTCFLGQSAEVCYHEEHLANALGYQTKWGVHGKYLQRRLQVRGMRAVVDPDGPIHVEALSCSQSWVRHLTLNNDVTPGFVRLTSIRIVSNTEPTAFRIFRFGAHKWYG

SEQ ID NO: 140 - protein, 3637 aa, Porcine reproductive and respiratory syndrome virus
MQSGFDRCLCTPNARVFWERGQVYCTRCLAARPLLPLSQQHPRLGALGLFYRPASPLSWEAPVTYPTKECRPGGMCWLSSIYPIARMTSGNHNFQARLNFIASVVYRDGKLTSKHLEEDFEVYSRGCRWYPITGPVPGIALYANAVHVSDESFPGATHVLSNLPLPQQPLRKGLCPFADARANVWRYKGNTVFVSPQGYLWTTGSNDSVPEPWGEDRRLCEKIISSLPADHLVKINFSNYPFDYSFTGGDGAGFVVFPCKERDTKFSKCWEKIFEDHSGWMAACEEADLADRMGYRTPAGVAGPYLARRLQVRGLRAVVKPENNDYIVWALGVPESYIRHVSRAGEPVEEFFVKVGEFSIVSNCVVTPHPKFRFQTRKYYGYSPPGDGACGLHCISAMLNDIFGDSFTTRLGKCSRDSSEWLSDQDLYQLVMTANLPATIGHCPSAIYKLDCVNQHWTVTKRKGDRAVGRLAPDCLRGVCGECEMGIHIGADTDLSPIVELQLAQDVSPRPGALLWFLELHELCVVDDDFAHAIARAGEEYRRAMGIPRDDWVILAELMTENCRTRHQVLEKLQRGLQLQASSRPSSPASVSPASSVDLSAAGLLLSGTESDKEAVVAVNDGCYTVLGFDKNEATKSEQDLATDLFCDLVKPMETSTTKLESRKILEAAAKALESCKPKRKRSRKKKTRTPSPTCSVDAAVAEPTSVNSLGNQDTRETCASEKKAEKCPTPTPPPRPKRAALKNSNSGCVLKDIIWNQTGPGVKCLTIVEDVRAFLKGITPPGGVLSTRSRITKHIVDHFHSICEQTPELVLAHAEHQAKNLHELLASETAKLILGIGEDPLKKLVGSQRSLPRRLGFGAWLGGQQKTSGGCGEREFKDVGRKSGAERTPSKRDLGVSLGDQLSQDGARRLSSSTACEIKESVPPIIDSGGGLSQKFMAWLNHQVFVLSSHLLAVWSFIFGSRQVLGVFDYVYTLFCLCCVLLCFYLPAIGFMTLVGCVFGSPWRVRLSVFSVWLCVAVVVFQEVLPEPGAVCTSASAERAAALERYTSNGVHRPVNHLSVGLVGTVAGFVARSVGGPRRYWFYFLRLMVLLDLGLVFLAVALRGSCKKCFCKCVRTASHEVQLRVFPSTKVARTTLEAICDMYSAPRVDPIFIATGVRGCWTGSVSPHQVTEKPVSYSNLDDKKISNKTVVPPPTDPQQAVRCLKVLQCGGSIQDVSVPEVKKVTKVPFKAPFFPNVTIDPECYIVVDPVTYSAAMRGGYGVSHLIVGLGDFAEVNGLRFVSGGQIADFVCLGLYVLLNFLLSAWLSSPVSCGRGTNDPWCRNPFSYPVVGQGVMCNSHLCVAEDGLTSPMTLSYSLIDWALMVAIMATVAIFFAKISLLVDVVCVFCCLLMYAFPSLSIAAFGFPFVLCKVSLHPITLVWVQFFLLAVNVWAGVASVVVLISSWFLARATSSLGLITPYDVHMITATPRGASSLASAPEGTYLAAVRRSALTGRCCMFVPTNFGSVLEGSLRTRGCAKNVVSVFGSASGSGGVFTINGNPVVVTASHLLSDGKARVSCVGFSQCLDFKCAGDYAFARVANWKGDAPKAELSHRRGRAYCSPLVGLSLDLLGKNSAFCFTKCGDSGSPVVDEDGNLLGIHTGSNKRGSGMVTTHGGKTLGMANVKLSEMCPHYSGPGVPVSTVKLPKHLVVDVETVSSDLVAVVESLPALEGALSSMQLLCVFFFLWRLIHVPDVPVIRIAFFFLNEILPVMLARLMFSFALSLFFCVHWLFCSSVAVAFGDCCSKSVTGYSVQVLLLRLVIAALNRPCGPFGFSLLGQLSQCCLMLCLLDIELQLLGCLYLGQLLMWPPKEIFFHPTGQFMFLPLFLSLFKRNALADMLVGNGCFDAAFFLKYFAEGNLRDGVSDSCNMTPEGLTAALAITLSDDDLEFLQRHSEFKCFVSASNMRNGAKEFIESAYARALRAQLAATDKIKASKSILAKLESFAGGVVTQVEPGDVVVVLGKKVIGDLVEVVINDAKHVIRVIETRTMAGTQFSVGTICGDLENACEDPSGLVKTSKKQARRQKRTGLGTEVVGTVVIDGVSYNKVWHIATGDVTYEGCLVTENPQLRPLGMTTIGRFQEFIRKHGEKVKTSVEKYPVGKKKSVEFNITTYLLDGEEYDVPDHEPLEWTITIGESDLEAERLTVDQALRHMGHDSLLTAKEKEKLARIIESLNGLQQASALNCLATSGLDRCTRGGLTVSGDAVKLVRYHSRTFSIGDVNLKVMGREEYGRTVGKQGHCLVANLVDGVVVMRKHEPSLVDVLLTGEDADLISPTHGPGNTGVHGFTWDFEAPPTDLELELSEQIITACSIRRGDAPSLDLPYKLHPVRGNPYRDRGVLYNTRFGDIKYLTPQKTKEPLHAAACFNPKGVPVSDSETLVATTLPHGFELYVPTIPQSVLEYLDSRPMHRKCCVRAVVRGLAECDLQKFDLSRQGFVLPGVLYMVRRYLCRLVGIRRRLFLPSTYPAKNSMAGINGNRFPTHVVQSHPDIDALCERACKEHWQTVTPCTLKKQYCSKAKTRTILGTNNFVALGLRSALSGVTQGFMRKGIGSPICLGKNKFTPLPTKVSGRCLEADLASCDRSTPAIIRWFTTNLLFELAGPEEWIPSYVLNCCHDAVSTMSGCFDKRGGLSSGDPVTSVSNTVYSLVIYAQHMVLSAFRCGHKVGGLFLRDSLEMEQLFELQPLLVYSDDVVLYDESSELPNYHFFVDHLDLMLGFKTDRSKTVITSDPQFPGCRIAAGRVLVPQRDRILAALAYHMKASCVSDYFASAAAILMDACACCDYDEDWYFDLVCGIADCARKEGFRFPGPSFYVDMWKRLSVEEKKKCRTCAHCGAPSTLVSSCGLNLCDYHGHGHPHCPVVLPCGHAVGSGVCDGCSSPVMSLNTELDKLLACVPYHPPKVELLSVNDGVSSLPPGRYQARGGVVSVRRDILGNVVDLPDGDYQVMKVAQTCADICMVSINSHILRSQFITGAPGTGKTTYLLSVVRDDDVIYTPTHRTMLDVVKALGTCRFDPPKDTPLEFPVPSRTGPCVRLIRAGFIPGRVSYLDEAAYCNPLDVLKILSKTPLVCVGDLNQLPPVDFIGPCYAFALMLGRQLIEVFRFGPSIVNPIKKFYREELVSRGPDTGVKFLKSYQPYGQVLTPYHRDRVDGAITIDSSQGCTYDVITVYLPTPKSLNSARALVAITRARFYVFVYDPHNQLEQYLNMSEHEPAGAVAFWCGEQPMMISEGRVQRLSGPAQTTDPKLQQLMGLEGTASPLPQVAHNLGFYYSPDLVQFARIPSELCKHWPVVTAQNRTDWPDRLVCSMSKIDKCSRAIFCAGYHVGPSVFLGVPGVVSYYLTKFLKGKPVPLPDSLMSTGRIALNVREYLDEKEMEFSSRCPHAFIGEVKGSNVGGCHHVTSRYLPPVLVPGSVVKIGVSCPGKAAKELCTVTDVYLPELDPYLNPPTKSMDYKLLVDFQPVKLMVWKDATAYFHEGIRPMESMSRFLKVPQEEGVFFDLDEFVTNAKVSKLPCKYSVSANQFLTDVVLSMTHPSLAPPDYELLFARAYCVPGLDVGTLNAYIYRRGPSTYTTSNIARLVKDICCPVGCKGSGYMFPK

SEQ ID NO: 141 - protein, 3616 aa, Porcine reproductive and respiratory syndrome virus
MQSGFDRCLCTPNARVFWEHGQVYCTRCLAARPLLPLSQQNPRLGALGLFYRPATPLTWEAPITYPTKECRPGGLCWLSGIYPIARMTSGNHNFQARLNFVASVVYRDGKLTSKHLEEEFEVYSRGCRWYPITGPVPGIALYANAVHVSDEPFPGCTHVLSNLPLPQQPLRKGLCPFSDARAEVWRYKGNTIFVSEQGYLWTTGSNDSVPEPWGEARRLCEKIIASLPADHLVKIEFSNYPFDYSFTGGDGAGYVLFPCKKNDTKFSKCWEKVFEDHSSWKVACEEADLADRMGYRTPAGVAGPYLARRLQYRGLRAVVKPEQNDYVVWALGVPESYIRHISRAGEPVENFFVRVGEFSIVSNCVATPYPKFRFQTRKYYGYSPPGDGACGLHCISAIINDIFGDALCTKLTNCSRDSSEWLSDQDMYQLVMTARLPATLGHCPSATYKLDCVNQHWTVTKRKGDRALGGLSPECVRGVCGGECKFVPTYPREINLELAAKSPISALAFSLGVEPYCDCWNFTNSVLVNDSLAVETARAGEAYRSAMGIPKDDWVLLAELMTENCLTRREVLDKLQRGLRLHATSKPGSPASVSPASSIDFSAAGLLLDGTESDKEAVVAVNNDCYTVLGFDKNSATKSEQELATGLFSELVEPMETSTSKHESRKILEAASRALKSAKPKRKRNKKKKTSSPTPTPPETPTREVPGAIEVVSGDEEAGACESATIVPDKAQARPPPRPKRQALKKAEQGFILKDIIWNPTESGVKCLTIVEDVRAFLKSITPPGGALGTRARITAHIVEQFHVIRESTPELVLAHAEHQAKNMHELLLSEKAKLILGIGEDTLKKLVSSQRSLPRSIGFGAWLSDQQKTADSCGEREFVEVPLKSGAEPTPSKRDLGVSLGDQLSQDGAPRLSSSTACEIKERVPPIKDSGGGLGQKFMAWLNHQVFLLSSHLLAMWSVVLGSRQKLNWADYVYTLFCLCCVLLCFHFPAIGFIPLAGCVFGSPWRVRLSVFSVWLCVAVVVFQEVLPEPGSVCSSASAECAAALERYSGNGVHRPVNHIGVGLVGTVAGFVARVVGGPRHYWFYFLRLMVVLDLGLVFLAVALRGRCKKCFCKCVRVAPHEVHLRVFPLTKVARPTLEAVCDMYSAPRVDPILVATGIKGCWQGKVSPHQVTDKPVSYSNLEEKKISNKTVVPPPTDPQQAVKCLKVLQCGGSIQDVGVPEVKKVSKVPYKAPFFPNVSIDPECYIVVDPVTYSAAMRGGYGVSHLIVGTGDFAEVNGLRFVSGGHVADFVCLGLYVMLNFLISAWLSSPVSCGRGTNDPWCKNPFSYPVVGQGVMCNSHLCISEDGLTSPMVLSYSLIDWALMIAVIATVAIFIAKVSLLVDVICVFLCLLMYVFPPLSVIAFAFPFALCKVHLHPVTLVWVQFFLLAVNFWAGVAVAVILISSWFLARATSSTGLVTPYDVHLVTSTPRGASSLASAPEGTYLAAVRRSALTGRCCMFVPTNFGSVLEGSLRTRGCAKNVVSVFGSASGSGGVFTIHGNPVVVTATHLLSDGKARVSCVGFSQCLTFKSVGDYAFARVAEWKGDAPKVELSDRRGRAYCSPQVEWSLVLLGPNTAFCFTKCGDSGSPVVDEDGNLIGVHTGSNKRGSGMITTHNGKTLGMSNVKLSEMCQHYGGSGVPVSTVRLPKHLIVDVEAVASDLVAVVESLPTPEGALSSVQLLCVFFFLWRLIHVPFVPVIAVAFFFLNEILPVVLARLMFSFALSLFSVFTGFSVQVLLLRLVIAALNRSAVSFGSFLLGQLFHCCLMPSHLETLGPVPGYFYPSTTEVASKEIFVTLLAIHVLALLLSLFKRPMLADVLVGNGSFDAAFFLKYFAEGNLRDGVSDSCNMTPEGLTAALAITLSDDDLEFLQRHSEFKCFVSASNMRNGAKEFIESAYARALRAQLAATDKIKASKSILAKLESFAGGVVTKVEPGDVVVVLGKKIVGDLVEITINDVKHVIRVIETRVMAGTQFSVGTICGDLENACEDPSGLVKTSKKQRRRQKRTGLGTEVVGTVEIDGVSYNKVWHKATGDVTYEGFLVSENSRLRTLGTSAIGRFQEFIRKHGSKVKTSVEKYPVGKNKHIEFAVTTYNLDGEEFDVPDHEPLEWTITIGDSDLEAERLTVDQALRHMGHDSLLTPKEKEKLARIIESLNGLQQSSALNCLTTSGLERCSRGGVTVSKDAVKIVKYHSRTFSIGDVNLKVMSFDEYRRTMGKPGHLLVAKLTDGVVVMRKHEPSLVDVILTGEDAEFFPRTHGPGNTGIHRFVWDFESPPVDLELELSEQIITACSMRRGDAPALDLPYKLHPVRGDPYRHRGVLFNTRFGDITYLIPEKTKEPLHAAACYNKGVPVSDSETLVATTLPHGFELYVPTLPPSVLEYLDSRPDTPRMLTKHGCASAAEKDLQKFDLSRQGFVLPGVLYMVRRYLSRLIGVRRRLFMPSTYPAKNSMAGINGGRFPLTWLQSHPDIDALCKRACEEHWQTVTPCTLKKQYCSKSKTRTILGTNNFVALGLRSALSGVTQGFMRKGIGTPICLGKNKFTPLPVRIGGRCLEADLASCDRSTPAIIRWFTTNLLFELAGAEEWIPSYVLNCCHDVVSTMSGCFDKRGGLSSGDPVTSISNTVYSLIIYAQHMVLSAFRCGHKIGGLFLQDSLEMEQLFELQPLLVYSDDVVFYNESDELPNYHFFVDHLDLMLGFKTDRSKTVITSEPKLPGCRISGGRVLVPQRDRIVAALAYQMKASCVGEYFASAAAILMDACACCDHDESWYFDLVCGIAECAGSPWFRFPGPSFFLDMWNRLSAEEKKKCRTCAHCGAPATLVSSCGLNLCDYHGHGHPHCPVVLPCGHAVGSGVCEQCSSSAMNLNTELDILLMCVPYHPPKVELLSVNDKVSSLPPGAYQARGGVVSVRRDILGNVVDLPDGDYQVMKVAQTCADISMVSVNSNILRSQFVTGAPGTGKTTYLLSVVRDDDVIYTPTHRTMLDVVKALKVCRFDPPKDTPLEFPVPGRTGPTVRLIGAGFVPGRVSYLDEAAYCNPLDVLKVLSKTPLVCVGDLNQLPPVGFNGPCFAFSLMPGRQLIEVFRFGPAVVNSIKKFYKEELVPRGPDTGVKFLKQYQPYGQVLTPYHRDRVDGAITIDSSQGCTYDVVTVYLPTPKSLNSARALVALTRARHYVFIYDPYDQLQQYLQVFEHEPADAWAFWCGDQPKMIVGGVVKQLAGHSRTTDLKLQQLMGLEGTASPLPQVGHNLGFYYSPDLIQFAKIPPELCKHWPVVTAQNRTEWPDRLVCGMNKMDKNSRAVFCAGYYVGPSIFLGVPGVVSYYLTKYLKGESVPLPDSIMSTGRIRLNVREYLDENEIEFAKKCPQPFIGEVKGSNVGGCHHVTSRFLPPVLVPGSVVKVGVSCPGKAAKGLCTVTDVYLPELDSYLHPPSKSMDYKLLVDFQPVKLMVWKDATAYFHEGIRPMEAMSRFLKVPEGEGVFFDLDEFVTNAKVSKLPCKYSVSAHQFLTEVVLSMTPTSEAPPDYELLFARAYCVPGLDVGTLNAYIYKRGPSTYTTSNFARLVKDTAVPVGCKGSGYMFPK

SEQ ID NO: 142 - protein, 3855 aa, Porcine reproductive and respiratory syndrome virus
MSGTFSRCMCTPAARVFWNAGQVFCTRCLSARSLLSPELQDTDLGAVGLFYKPRDKLHWKVPIGIPQVECTPSGCCWLSAVFPLARMTSGNHNFLQRLVKVADVLYRDGCLAPRHLRELQVYERGCNWYPITGPVPGMGLFANSMHVSDQPFPGATHVLTNSPLPQQACRQPFCPFEEAHSSVYRWKKFVVFTDSSLNGRSRMMWTPESDDSAALEVLPPELERQVEILIRSFPAHHPVDLADWELTESPENGFSFNTSHSCGHLVQNPDVFDGKCWLSCFLGQSVEVRCHEEHLADAFGYQTKWGVHGKYLQRRLQVRGIRAVVDPDGPIHVEALSCPQSWIRHLTLDDDVTPGFVRLTSLRIVPNTEPTTSRIFRFGAHKWYGAAGKRARAKRAAKSEKDSAPTPKVALPVPTCGITTYSPPTDGSCGWHVLAAIMNRMINGDFTSPLTQYNRPEDDWASDYDLVQAIQCLRLPATVVRNRACPNAKYLIKLNGVHWEVEVRSGMAPRSLSRECVVGVCSEGCVAPPYPADGLPKRALEALASAYRLPSDCVSSGIADFLANPPPQEFWTLDKMLTSPSPERSGFSSLYKLLLEVVPQKCGATEGAFIYAVERMLKDCPSSKQAMALLAKIKVPSSKAPSVSLDECFPTDVLADFEPASQERPQSSGAAVVLCSPDAKEFEEAAPEEVQESGHKAVHSALLAEGPNNEQVQVVAGEQLKLGGCGLAVGNAHEGALVSAGLINLVGGNLSPSDPMKENMLNSREDEPLDLSQPAPASTTTLVREQTPDNPGSDAGALPVTVREFVPTGPILCHVEHCGTESGDSSSPLDLSDAQTLDQPLNLSLAAWPVRATASDPGWVHGRREPVFVKPRNAFSDGDSALQFGELSESSSVIEFDRTKDAPVVDAPVDLTTSNEALSVVDPFEFAELKRPRFSAQALIDRGGPLADVHAKIKNRVYEQCLQACEPGSRATPATREWLDKMWDRVDMKTWRCTSQFQAGRILASLKFLPDMIQDTPPPVPRKNRASDNAGLKQLVAQWDRKLSVTPPPKPVGPVLDQIVPPPTDIQQEDVTPSDGPPHAPDFPSRVSTGGSWKGLMLSGTRLAGSISQRLMTWVFEVFSHLPAFMLTLFSPRGSMAPGDWLFAGVVLLALLLCRSYPILGCLPLLGVFSGSLRRVRLGVFGSWMAFAVFLFSTPSNPVGSSCDHDSPECHAELLALEQRQLWEPVRGLVVGPSGLLCVILGKLLGGSRYLWHVLLRLCMLADLALSLVYVVSQGRCHKCWGKCIRTAPAEVALNVFPFSRATRVSLVSLCDRFQTPKGVDPVHLATGWRGCWRGESPIHQPHQKPIAYANLDEKKMSAQTVVAVPYDPSQAIKCLKVLQAGGAIVDQPTPEVVRVSEIPFSAPFFPKVPVNPDCRVVVDSDTFVAAVRCGYSTAQLVLGRGNFAKLNQTPPRNSISTKTTGGASYTLAVAQVSAWTLVHFILGLWFTSPQVCGRGTADPWCSNPFSYPTYGPGVVCSSRLCVSADGVTLPLFSAVAQLSGREVGIFILVLVSLTALAHRMALKADMLVVFSAFCAYAWPMSSWLICFFPILLKWVTLHPLTMLWVHSFLVFCLPAAGILSLGITGLLWAIGRFTQVAGIITPYDIHQYTSGPRGAAAVATAPEGTYMAAVRRAALTGRTLIFTPSAVGSLLEGAFRTHKPCLNTVNVVGSSLGSGGVFTIDGRRTVVTAAHVLNGDTARVTGDSYNRMHTFKTNGDYAWSHADDWQGVAPVVKVAKGYRGRAYWQTSTGVEPGIIGEGFAFCFTNCGDSGSPVISESGDLIGIHTGSNKLGSGLVTTPEGETCTIKETKLSDLSRHFAGPSVPLGDIKLSPAIIPDVTSIPSDLASLLASVPVVEGGLSTVQLLCVFFLLWRMMGHAWTPIVAVGFFLLNEILPAVLVRAVFSFALFVLAWATPWSAQVLMIRLLTASLNRNKLSLAFYALGGVVGLAAEIGTFAGRLSELSQALSTYCFLPRVLAMTSCVPTIIIGGLHTLGVILWLFKYRCLHNMLVGDGSFSSAFFLRYFAEGNLRKGVSQSCGMNNESLTAALACKLSQADLDFLSSLTNFKCFVSASNMKNAAGQYIEAAYAKALRQELASLVQIDKMKGVLSKLEAFAETATPSLDIGDVIVLLGQHPHGSILDINVGTERKTVSVQETRSLGGSKFSVCTVVSNTPVDALTGIPLQTPTPLFENGPRHRSEEDDLKVERMKKHCVSLGFHNINGKVYCKIWDKSTGDTFYTDDSRYTQDHAFQDRSADYRDRDYEGVQTTPQQGFDPKSETPVGTVVIGGITYNRYLIKGKEVLVPKPDNCLEAAKLSLEQALAGMGQTCDLTAAEVEKLKRIISQLQGLTTEQALNCLLAASGLTRCGRGGLVVTETAVKIIKYHSRTFTLGPLDLKVTSEVEVKKSTEQGHAVVANLCSGVILMRPHPPSLVDVLLKPGLDTIPGIQPGHGAGNMGVDGSIWDFETAPTKAELELSKQIIQACEVRRGDAPNLQLPYKLYPVRGDPERHKGRLINTRFGDLPYKTPQDTKSAIHAACCLHPNGAPVSDGKSTLGTTLQHGFELYVPTVPYSVMEYLDSRPDTPFMCTKHGTSKAAAEDLQKYDLSTQGFVLPGVLRLVRRFIFGHIGKAPPLFLPSTYPAKNSMAGINGQRFPTKDVQSIPEIDEMCARAVKENWQTVTPCTLKKQYCSKPKTRTILGTNNFIALAHRSALSGVTQAFMKKAWKSPIALGKNKFKELHCTVAGRCLEADLASCDRSTPAIVRWFVANLLYELAGCEEYLPSYVLNCCHDLVATQDGAFTKRGGLSSGDPVTSVSNTVYSLVIYAQHMVLSALKMGHEIGLKFLEEQLKFEDLLEIQPMLVYSDDLVLYAERPTFPNYHWWVEHLDLMLGFRTDPKKTVITDKPSFLGCRIEAGRQLVPNRDRILAALAYHMKAQNASEYYASAAAILMDSCACIDHDPEWYEDLICGIARCARQDGYSFPGPAFFMSMWEKLRSHNEGKKFRHCGICDAKADYASACGLDLCLFHSHFHQHCPVTLSCGHHAGSKECSQCQSPVGAGRSPLDAVLKQIPYKPPRTVIMKVGNKTTALDPGRYQSRRGLVAVKRGIAGNEVDLSDGDYQVVPLLPTCKDINMVKVACNVLLSKFIVGPPGSGKTTWLLSQVQDDDVIYTPTHQTMFDIVSALKVCRYSIPGASGLPFPPPARSGPWVRLIASGHVPGRVSYLDEAGYCNHLDILRLLSKTPLVCLGDLQQLHPVGFDSYCYVFDQMPQKQLTTIYRFGPNICAAIQPCYREKLESKARNTRVVFTTRPVAFGQVLTPYHKDRIGSAITIDSSQGATFDIVTLHLPSPKSLNKSRALVAITRARHGLFIYDPHNQLQEFFNLTPERTDCNLVFSRGDELVVLNADNAVTTVAKALETGPSRFRVSDPRCKSLLAACSASLEGSCMPLPQVAHNLGFYFSPDSPTFAPLPKELAPHWPVVTHQNNRAWPDRLVASMRPIDARYSKPMVGAGYVVGPSTFLGTPGVVSYYLTLYIRGEPQALPETLVSTGRIATDCREYLDAAEEEAAKELPHAFIGDVKGTTVGGCHHITSKYLPRSLPKDSVAVVGVSSPGRAAKAVCTLTDVYLPELRPYLQPETASKCWKLKLDFRDVRLMVWKGATAYFQLEGLTWSALPDYARFIQLPKDAVVYIDPCIGPATANRKVVRTTDWRADLAVTPYDYGAQNILTTAWFEDLGPQWKILGLQPFRRAFGFENTEDWAILARRMNDGKDYTDYNWNCVRERPHAIYGRARDHTYHFAPGTELQVELGKPRLPPGQVP

SEQ ID NO: 143 - protein, 3838 aa, Porcine reproductive and respiratory syndrome virus
MSGTFSRCMCTPAARVFWNAGQVFCTRCLSARPLLSPELQDTDLGVVGLFYKPKDKIHWKVPIGIPQVECTPSGCCWLSAVFPLARMTSGNHNFLQRLVKVADVLYRDGCLAPRHLRELQVYERGCSWYPITGPVPGMGLFANSMHVSDQPFPGATHVLTNSPLPQRACRQPFCPFEEAHSDVYRWKKFVIFTDSSPNGRFRMMWTPESDDSAALEVLPPELERQVEILTRSFPAHHPINLADWELTESPENGFSFGTSHSCGHIVQNPNVFDGKCWLTCFLGQSAEVCYHEEHLANALGYQTKWGVHGKYLQRRLQVRGMRAVVDPDGPIHVEALSCSQSWVRHLTLNNDVTPGFVRLTSIRIVSNTEPTAFRIFRFGAHKWYGAAGKRARAKRATKSGKDSALAPKIAPPVPTCGITTYSPPTDGSCGWHVLAAIVNRMINGDFTSPLPQYNRPEDDWASDYDLAQAIQCLQLPATVVRNRACPNAKYLIKLNGVHWEVEVRSGMAPRSLSRECVVGVCSEGCVAPPYPADGLPKRALEALASAYRLPSDCVSSGIADFLADPPPQEFWTLDKMLTSPSPERSGFSSLYKLLLEVVPQKCGATEGAFVYAVERMLKDCPSPEQAMALLAKIKVPSSKAPSVSLDECFPAGVPADFEPAFQERPRSPGAAVALCSPDAKGFEGTASEEAQESGHKAVHAVPLAEGPNNEQVQVVAGEQLELGGCGLAIGSAQSSSDSKRENMHNSREDEPLDLSHPAPAATTTLVGEQTPDNPGSDASALPIAVRGFVPTGPILRHVEHCGTESGDSSSPLDLSFAQTLDQPLDLSLAAWPVKATASDPGWVRGRCEPVFLKPRKAFSDGDSALQFGELSESSSVIEFDQTKDTLVADAPVDLTTSNEALSAVDPSEFVELRRPRHSAQALIDRGGPLADVHAKIKNRVYEQCLQACEPGSRATPATREWLDKMWDRVDMKTWRCTSQFQAGRILASLKFLPDMIQDTPPPVPRKNRASDNAGLKQLVARWDKKLSVTPPPKSAGLVLDQTVPPPTDIQQEDATPSDGLSHASDFSSRVSTSWSWKGLMLSGTRLAGSAGQRLMTWVFEVYSHLPAFILTLFSPRGSMAPGDWLFAGVVLLALLLCRSYPILGCLPLLGVFSGSLRRVRLGVFGSWMAFAVFLFSTPSNPVGSSCDHDSPECHAELLALEQRQLWEPVRGLVVGPSGLLCVILGKLLGGSRHLWHVILRLCMLTDLALSLVYVVSQGRCHKCWGKCIRTAPAEVALNVFPFSRATRNSLTSLCDRFQTPKGVDPVHLATGWRGCWRGESPIHQPHQKPIAYANLDEKKISAQTVVAVPYDPSQAIKCLKVLQAGGAIVDQPTPEVVRVSEIPFSAPFFPKVPVNPDCRIVVDSDTFVAAVRCGYSTAQLVLGRGNFAKLNQTPLRDSASTKTTGGASYTLAVAQVSVWTLVHFILGLWFTSPQVCGRGTADPWCSNPFSYPAYGPGVVCSSRLCVSADGVTLPLFSAVAQLSGREVGIFILVLVSLTALAHRLALKADMLVVFSAFCAYAWPMSSWLICFFPILLKWVTLHPLTMLWVHSFLVFCMPAAGILSLGITGLLWAVGRFTQVAGIITPYDIHQYTSGPRGAAAVATAPEGTYMAAVRRAALTGRTLIFTPSAVGSLLEGAFRTHKPCLNTVNVVGSSLGSGGVFTIDGRKTVVTAAHVLNGDTARVTGDSYNRMHTFKTSGDYAWSHADDWQGVAPVVKVAKGYRGRAYWQTSTGVEPGVIGEGFAFCFTNCGDSGSPVISESGDLIGIHTGSNKLGSGLVTTPEGETCAIKETKLSDLSRHFAGPSVPLGDIKLSPAIVPDVTSIPSDLASLLASVPVMEGGLSTVQLLCVFFLLWRMMGHAWTPIVAVGFFLLNEILPAVLVRAVFSFALFILAWATPWSAQVLMIRLLTASLNRNKLSLAFYALGGVVGLAAEIGAFAGRLPELSQALSTYCFLPRVLAMASYVPIIIIGGLHALGVILWLFKYRCLHNMLVGDGSFSSAFFLRYFAEGNLRKGVSQSCGMSNESLTAALACKLSQADLDFLSSLTNFKCFVSASNMKNAAGQYIEAAYAKALRQELASLVQVDKMKGILSKLEAFAETATPSLDAGDVVVLLGQHPHGSILDINVGTERKTVSVQETRSLGGSKFSVCTVVSNTPVDALTGIPLQTPTPLFENGPRHRGEEDDLRVERMKKHCVSLGFHNINGKVYCKIWDKSTGDTFYTDDSRYTQDLAFQDRSADYRDRDYEGVQTAPQQGFDPKSETPIGTVVIGGITYNRYLIKGKEVLVPKPDNCLEAAKLSLEQALAGMGQTCDLTAAEVEKLRRIISQLQGLTTEQALNCLLAASGLTRCGRGGLVVTETAVKIVKYHSRTFTLGPLDLKVTSEAEVKKSTEQGHAVVANLCSGVILMRPHPPSLVDVLLKPGLDTKPGIQPGHGAGNMGVDGSTWDFETAPTKAELELSKQIIQACEVRRGDAPNLQLPYKLYPVRGDPERHGGRLINTRFGDLSYKTPQDTKSAIHAACCLHPNGAPVSDGKSTLGTTLQHGFELYVPTVPYSVMEYLDSRPDTPFMCTKHGTSKAAAEDLQKYDLSTQGFVLPGVLRLVRRFIFGHIGKAPPLFLPSTYPAKNSMAGINGQRFPTKDVQSIPEIDEMCARAVKENWQTVTPCTLKKQYCSKPKTRTILGTNNFIALAHRSALSGVTQAFMKKAWKSPIALGKNKFKELHCTVAGRCLEADLASCDRSTPAIVRWFVANLLYELAGCEEYLPSYVLNCCHDLVATQDGAFTKRGGLSSGDPVTSVSNTVYSLIIYAQHMVLSALKMGHEIGLKFLEEQLKFEDLLEIQPMLVYSDDLVLYAERPTFPNYHWWVEHLDLMLGFRTDPKKTVITDKPSFLGCRIEAGRQLVPNRDRILAALAYHMKAQNASEYYASAAAILMDSCACIDHDPEWYEDLICGIARCARQDGYSFPGPAFFMSMWEKLRSHNEGKKFRHCGICDAKADHASACGLDLCLFHSHFHQHCPVTLSCGHHAGSRECSQCQSPVGAGRSPLDAVLKQIPYKPPRTVIMKVGNKTTALDPGRYQSRRGLVAVKRGIAGNEVDLPDGDYQVVPLLPTCKDINMVKVACNVLLSKFIVGPPGSGKTTWLLSQVQDDDVIYTPTHQTMFDIVSALKVCRYSIPGASGLPFPPPARSGPWVRLVASGHVPGRTSYLDEAGYCNHLDILRLLSKTPLVCLGDLQQLHPVGFDSYCYVFDQMPQKQLTTIYRFGPNICAAIQPCYREKLESKARNTRVVFTTWPVAFGQVLTPYHKDRIGSAITIDSSQGATFDIVTLHLPSPKSLNKSRALVAITRARHGLFIYDPHNQLQEFFNLIPERTDCNLVFSRGDDLVVLSADNAVTTVAKALGTGPSRFRVSDPRCKSLLAACSASLEGSCMPLPQVAHNLGFYFSPDSPAFAPLPKELAPHWPVVTHQNNRAWPDRLVASMRPIDARYSKPMVGAGYVVGPSTFLGTPGVVSYYLTLYIRGEPQALPETLVSTGRIATDCREYLDAAEEEAAKELPHAFIGDVKGTTVGGCHHITSKYLPRTLPKDSVAVVGVSSPGRAAKAMCTLTDVYLPELRPYLQPETASKCWKLKLDFRDVRLMVWKGATAYFQLEGLTWSALPDYARFIQLPKDAVVYIDPCIGPATANRKVVRTTDWRADLAVTPYDYGAQNILTTAWFEDLGPQWKILGLQPFRRAFGFENTEDWAILARRMSDGKDYTDYNWDCVRERPHAIYGRARDHTYHFAPGTELQVELGKPRLPPGREP

SEQ ID NO: 144 - protein, 203 aa, Porcine reproductive and respiratory syndrome virus
ADVYDIGRGAVMYVAGGKVSWAPRGGNEVKFEPVPKELKLVANRLHTSFPPHHVVDMSKFTFITPGSGVSMRVEYQYGCLPADTVPEGNCWWRLLDSLPPEVQYKEIRHANQFGYQTKHGVPGKYLQRRLQVNGLRAVTDTHGPIVIQYFSVKESWIRHLKLVEEPSLPGFEDLLRIRVEPNTSPLAGKDEKIFRFGSHKWYG

SEQ ID NO: 145 - protein, 3961 aa, Porcine reproductive and respiratory syndrome virus
MSGILDRCTCTPNARVFVAEGQVYCTRCLSARSLLPLNLQVPELGVLGLFYRPEEPLRWTLPRAFPTVECSPTGACWLSAIFPIARMTSGNLNFQQRMVRVAGEIYRAGQLTPTVLKTIQVYERGCRWYPIVGPVPGVGVYANSLHVSDKPFPGATHVLTNLPLPQRPKPEDFCPFECAMADVYDIGRGAVMYVAGGKVSWAPRGGDEVKFEPVPKELKLVANRLHTSFPPHHVVDMSKFTFMTPGSGVSMRVEYQYGCLPADTVPEGNCWWRLFDLLPPEVQNKEIRHANQFGYQTKHGVPGKYLQRRLQVNGLRAVTDTHGPIVIQYFSVKESWIRHLKPVEEPSLPGFEDLLRIRVEPNTSPLAGKNEKIFRFGSHKWYGAGKRARKARSGATTMVAHRASSAHETRQATKHEGAGANKAEHLKLYSPPAEGNCGWHCISAIVNRMVNSNFETTLPERVRPPDDWATDEDLVNTIQILRLPAALDRNGACGGAKYVLKLEGEHWTVSVNPGMSPSLLPLECVQGCCEHKGGLGSPDAVEVSGFDPACLDRLLQVMHLPSSTIPAALAELSDDSNRPVSPAAATWTVSQSYARHRGGNHHDQVCLGKIISLCQVIEDCCCHQNKTNRATPEEVAAKIDQYLRGATSLEECLAKLERVSPPGAADTSFDWNVVLPGVEAAHQTTEQLHVNPCRTLVPPVTQEPLGKDSVPLTAFSLSNCYYPAQGNEVRHRERLNSVLSKLEEVVLEEYGLMSTGLGPRPVLPSGLDELKDQMEEDLLKLANTQATSEMMAWAAEQVDLKAWVKSYPRWTPPPPPPRVQPRKTKSVKSLPEDKPVPAPRRKVRSGCGSPVLMGDNVPNGSEDLTVGGPLNFPTPSEPMTPMSEPVLTPALQRVPKLMTPLDGSAPVPAPRRTVSRPMTPLSEPIFLSAPRHKFQQVEEANPATTTLTHQNEPLDLSASSQTEYEASPLASSQNMSILEAGGQEAEEVLSEISDILNDTSPAPVSSSSSLSSVKITRPKYSAQAIIDSGGPCSGHLQKEKEACLSIMREACDASKLSDPATQEWLSRMWDRVDMLTWRNTSAYQAFRTLNGRFEFLPKMILETPPPHPCGFVMLPHTPAPSVSAESDLTIGSVATEDVPRILGKIGDTGELLNQGPSAPFKGGPVCDQPAKNSRMSPRESDESIIAPPADTGGAGSFTDLPSSDSVDANGGGPLRTVKTKAGRLLDQLSCQVFSLVSHLPVFFSHLFKSDSGYSPGDWGFAAFTLFCLFLCYSYPFFGFAPLLGVFSGSSRRVRMGVFGCWLAFAVGLFKPVSDPVGTACEFDSPECRNVLHSFELLKPWDPVRSLVVGPVGLGLAILGRLLGGARYVWHFLLRFGIVADCILAGAYVLSQGRCKKCWGSCVRTAPNEIAFNVFPFTRATRSSLIDLCDRFCAPKGMDPIFLATVWRGCWTGRSPIEQPSEKPIAFAQLDEKRITARTVVAQPYDPNQAVKCLRVLQAGGAMVAEAVPKVVKVSAIPFRAPFFPAGVKVDPECRIVVDPDTFTTALRSGYSTTNLVLGMGDFAQLNGLKIRQISKPSGGGSHLVAALHVACSMALHMLAGVYVTAVGSCGTGTNDPWCTNPFAAPGYGPGSLCTSRLCISQHGLTLPLTALVAGFGLQEIALVVLIFVSMGGMAHRLSCKADMLCILLAIASYVWVPLTWLLCVFPCWLRWFSLHPLTILWLVFFLISVNIPSGILAVVLLVSLWLLGRYTNIAGLVTPYDIHHYTSGPRGVAALATAPDGTYLAAVRRAALTGRTMLFTPSQLGSLLEGAFRTQKPSLNTVNVVGSSMGSGGVFTIDGKIKCVTAAHVLTGNSARVSGVGFNQMLDFDVKGDFAIADCPNWQGAAPKAQFCEDGWTGRAYWLTSSGVEPGVIGNGFAFCFTACGDSGSPVITEAGELVGVHTGSNKQGGGIVTRPSGQFCNVTPIKLSELSEFFAGPKVPLGDVKIGSHIIKDTCEVPSDLCALLAAKPELEGGLSTVQLLCVFFLLWRMMGHAWTPLVAVGFFILNEILPAVLVRSVFSFGMFVLSWLTPWSAQVLMIRLLTAALNRNRLSLGFYSLGAVTSFVADLAVTQGHPLQVVMNLSTYAFLPRMMVVTSPVPVIACGVVHLLAIILYLFKYRCLHYVLVGDGVFSSAFFLRYFAEGKLREGVSQSCGMSHESLTGALAMRLTDEDLDFLTKWTDFKCFVSASNMRNAAGQFIEAAYAKALRIELAQLVQVDKVRGTLAKLEAFADTVAPQLSPGDIVVALGHTPVGSIFDLKVGSTKHTLQAIETRVLAGSKMTVARVVDPTPAPPPVPVPIPLPPKVLENGPNAWGDEDRLNKKKRRRMEAVGIFVMDGKKYQKFWDKNSGDVFYEEVHNSTDEWECLRAGDPADFDPETGVQCGHITIEDRVYNVFTSPSGRKFLVPANPENRRAQWEAAKLSVEQALGMMNVDGELTAKELEKLKGIIDKLQGLTKEQCLNCLLAASGLTRCGRGGLVVTETAVKIVKFHNRTFTLGPVNLKVASEVELKDAVEHNQHPVARPVDGGVVLLRSAVPSLIDVLISGADASPKLLARHGPGNTGIDGTLWDFEAEATKEEVALSAQIIQACDIRRGDAPEIGLPYKLYPVRGNPERVKGVLQNTRFGDIPYKTPSDTGSPVHAAACLTPNATPVTDGRSVLATTMPSGFELYVPTIPASVLDYLDSRPDCPKQLTEHGCEDAALRDLSKYDLVTQGFVLPGVLRLVRKYLFAHVGKCPPVHRPSTYPAKNSMAGINGNRFPTKDIQSVPEIDVLCAQAVRENWQTVTPCTLKKQYCGKKKTRTILGTNNFIALAHRAALSGVTQGFMKKAFNSPIALGKNKFKELQTPVLGRCLEADLASCDRSTPAIVRWFAANLLYELACAEEHLPSYVLNCCHDLLVTQSGAVTKRGGLSSGDPITSVSNTIYSLVIYAQHMVLSYFKSGHPHGLLFLQDQLKFEDMLKVQPLIVYSDDLVLYAESPSMPNYHWWVEHLNLMLGFQTDPKKTAITDSPTFLGCRIINGRQLVPNRDRILAALAYHMKASNVSEYYASAAAILMDSCACLEYDPEWFEELVVGIAQCARKDGYSFPGPPFFLSMWEKLRSNHEGKKSRMCGYCMAPAPYATACGLDVCVYHTHFHQHCPVIIWCGHPAGSGSCGECEPPLGKGTSPLDEVLEQVPYKPPRTVIMHVEQGLTPLDPGRYQTRRGLVSVRRGIRGNEVDLPDGDYASTALLPTCKEINMVAVAPNVLRSRFIIGPPGAGKTHWLLQQVQDGDVIYTPTHQTMLDMIRALGTCRFNVPAGTTLQFPAPSRTGPWVRILAGGWCPGKNSFLDEAAYCNHLDVLRLLSKTTLTCLGDFKQLHPVGFDSHCYVFDIMPQTQLKTIWRFGQNICDAIQPDYRDKLVSMVNTTRVTYVEKPVRYGQVLTPYHRDREDGAITIDSSQGATFDVVTLHLPTKDSLNRQRALVAITRARHAIFVYDPHRQLQSMFDLPAKGTPVNLAVHRDEQLIVLDRNNKEITVAQALGNGDKFRATDKRVVDSLRAICADLEGSSSPLPKVAHNLGFYFSPDLTQFAKLPAELAPHWPVVTTQNNERWPDRLVASLRPIHKYSRACIGAGYMVGPSVFLGTPGVVSYYLTKFVRGEAQVLPETVFSTGRIEVDCREYLDDREREVAESLPHAFIGDVKGTTVGGCHHVTSKYLPRFLPKESVAVVGVSSPGEAAKAFCTLTDVYLPDLEAYLHPETQSKCWKVMLDFKEVRLMVWKGKTAYFQLEGRHFTWYQLASYTSYIRVPVNSTVYLDPCMGPALCNRRVVGSTHWGADLAVTPYDYGAKIILSSAYHGEMPPGYKILACAEFSLDDPVRYKHTWGFESDTAYLYEFTGNGEDWEDYNGAFRARQKGKIYKATATSMKFHFPPGPVIEPTLGLN

SEQ ID NO: 146 - protein, 3960 aa, Porcine reproductive and respiratory syndrome virus
MSGILDRCTCTPNARVFMAEGQVYCTRCLSARSLLPLNLQVSELGVLGLFYRPEEPLRWTLPRAFPTVECSPAGACWLSAIFPIARMTSGNLNFQQRMVRVAAELYRAGQLTPAVLKALQVYERGCRWYPIVGPVPGVAVFANSLHVSDKPFPGATHVLTNLPLPQRPKPEDFCPFECAMATVYDIGHDAVMYVAERKVSWAPRGGDEVKFEAVPGELKLIANRLRTSFPPHHTVDMSKFAFTAPGCGVSMRVERQHGCLPADTVPEGNCWWSLFDLLPLEVQNKEIRHANQFGYQTKHGVSGKYLQRRLQVNGLRAVTDLNGPIVVQYFSVKESWIRHLKLAGEPSYSGFEDLLRIRVEPNTSPLADKEEKIFRFGSHKWYGAGKRARKARSCATATVAGRALSVRETRQAKEHEVAGANKAEHLKHYSPPAEGNCGWHCISAIANRMVNSKFETTLPERVRPPDDWATDEDLVNAIQILRLPAALDRNGACTSAKYVLKLEGEHWTVTVTPGMSPSLLPLECVQGCCGHKGGLGSPDAVEVSGFDPACLDRLAEVMHLPSSAIPAALAEMSGDSDRSASPVTTVWTVSQFFARHSGGNHPDQVRLGKIISLCQVIEDCCCSQNKTNRVTPEEVAAKIDLYLRGATNLEECLARLEKARPPRVIDTSFDWDVVLPGVEAATQTIKLPQVNQCRALVPVVTQKSLDNNSVPLTAFSLANYYYRAQGDEVRHRERLTAVLSKLEKVVREEYGLMPTEPGPRPTLPRGLDELKDQMEEDLLKLANAQTTSDMMAWAVEQVDLKTWVKNYPRWTPPPPPPKVQPRKTKPVKSLPERKPVPAPRRKVGSDCGSPVSLGGDVPNSWEDLAVSSPFDLPTPPEPATPSSELVIVSSPQCIFRPATPLSEPAPIPAPRGTVSRPVTPLSEPIPVPAPRRKFQQVKRLSSAAAIPPYQDEPLDLSASSQTEYEASPPAPPQSGGVLGVEGHEAEETLSEISDMSGNIKPASVSSSSSLSSVRITRPKYSAQAIIDSGGPCSGHLQEVKETCLSVMREACDATKLDDPATQEWLSRMWDRVDMLTWRNTSVYQAICTLDGRLKFLPKMILETPPPYPCEFVMMPHTPAPSVGAESDLTIGSVATEDVPRILEKIENVGEMANQGPLAFSEDKPVDDQLVNDPRISSRRPDESTSAPSAGTGGAGSFTDLPPSDGADADGGGPFRTVKRKAERLFDQLSRQVFDLVSHLPVFFSRLFYPGGGYSPGDWGFAAFTLLCLFLCYSYPAFGIAPLLGVFSGSSRRVRMGVFGCWLAFAVGLFKPVSDPVGAACEFDSPECRNILHSFELLKPWDPVRSLVVGPVGLGLAILGRLLGGARCIWHFLLRLGIVADCILAGAYVLSQGRCKKCWGSCIRTAPNEVAFNVFPFTRATRSSLIDLCDRFCAPKGMDPIFLATGWRGCWAGRSPIEQPSEKPIAFAQLDEKKITARTVVAQPYDPNQAVKCLRVLQSGGAMVAKAVPKVVKVSAVPFRAPFFPTGVKVDPDCRVVVDPDTFTAALRSGYSTTNLVLGVGDFAQLNGLKIRQISKPSGGGPHLMAALHVACSMALHMLAGIYVTAVGSCGTGTNDPWCANPFAVPGYGPGSLCTSRLCISQHGLTLPLTALVAGFGIQEIALVVLIFVSIGGMAHRLSCKADMLCVLLAIASYVWVPLTWLLCVFPCWLRCFSLHPLTILWLVFFLISVNMPSGILAMVLLVSLWLLGRYTNVAGLVTPYDIHHYTSGPRGVAALATAPDGTYLAAVRRAALTGRTMLFTPSQLGSLLEGAFRTRKPSLNTVNVIGSSMGSGGVFTIDGKVKCVTAAHVLTGNSARVSGVGFNQMLDFDVKGDFAIADCPNWQGAAPKTQFCTDGWTGRAYWLTSSGVEPGVIGKGFAFCFTACGDSGSPVITEAGELVGVHTGSNKQGGGIVTRPSGQFCNVAPIKLSELSEFFAGPKVPLGDVKVGSHIIKDISEVPSDLCALLAAKPELEGGLSTVQLLCVFFLLWRMMGHAWTPLVAVSFFILNEVLPAVLVRSVFSFGMFVLSWLTPWSAQVLMIRLLTAALNRNRWSLAFFSLGAVTGFVADLAATQGHPLQAVMNLSTYAFLPRMMVVTSPVPVITCGVVHLLAIILYLFKYRGPHHILVGDGVFSAAFFLRYFAEGKLREGVSQSCGMNHESLTGALAMRLNDEDLDFLMKWTDFKCFVSASNMRNAAGQFIEAAYAKALRVELAQLVQVDKVRGTLAKLEAFADTVAPQLSPGDIVVALGHTPVGSIFDLKVGSTKHTLQAIETRVLAGSKMTVARVVDPTPTPPPAPVPIPLPPKVLENGPNAWGDEDRLNKKKRRRMEALGIYVMGGKKYQKFWDKNSGDVFYEEVHNNTDEWECLRVGDPADFDPEKGTLCGHVTIENKAYHVYTSPSGKKFLVPVNPENGRVQWEAAKLSVEQALGMMNVDGELTAKELEKLKRIIDKLQGLTKEQCLNCLAASDLTRCGRGGLVVTETAVKIVKFHNRTFTLGPVNLKVASEVELKDAVEHNQHPVARPIDGGVVLLRSAVPSLIDVLISGADASPKLLAHHGPGNTGIDGTLWDFESEATKEEVALSAQIIQACDIRRGDAPEIGLPYKLYPVRGNPERVKGVLQNTRFGDIPYKTPSDTGSPVHAAACLTPNATPVTDGRSVLATTMPPGFELYVPTIPASVLDYLDSRPDCPKQLTEHGCEDAALKDLSKYDLSTQGFVLPGVLRLVRKYLFAHVGKCPPVHRPSTYPAKNSMAGINGNRFPTKDIQSVPEIDVLCAQAVRENWQTVTPCTLKKQYCGKKKTRTILGTNNFIALAHRAVLSGVTQGFMKKAFNSPIALGKNKFKELQTPVLGRCLEADLASCDRSTPAIVRWFAANLLYELACAEEHLPSYVLNCCHDLLVTQSGAVTKRGGLSSGDPITSVSNTIYSLVIYAQHMVLSYFKSGHPHGLLFLQDQLKFEDMLKVQPLIVYSDDLVLYAESPTMPNYHWWVEHLNLMLGFQTDPKKTAITDSPSFLGCRIINGRQLVPNRDRILAALAYHMKASNVSEYYASAAAILMDSCACLEYDPEWFEELVVGIAQCARKDGYSFPGTPFFMSMWEKLRSNYEGKKSRVCGYCGAPAPYATACGLDVCIYHTHFHQHCPVTIWCGHPAGSGSCSECKSPVGKGTSPLDEVLEQVPYKPPRTVIMHVEQGLTPLDPGRYQTRRGLVSVRRGIRGNEVGLPDGDYASTALLPTCKEINMVAVASNVLRSRFIIGPPGAGKTYWLLQQVQDGDVIYTPTHQTMLDMIRALGTCRFNVPAGTTLQFPVPSRTGPWVRILAGGWCPGKNSFLDEAAYCNHLDVLRLLSKTTLTCLGDFKQLHPVGFDSHCYVFDIMPQTQLKTIWRFGQNICDAIQPDYRDKLMSMVNTTRVTYVEKPVRYGQVLTPYHRDREDDAITIDSSQGATFDVVTLHLPTKDSLNRQRALVAITRARHAIFVYDPHRQLQGLFDLPAKGTPVNLAVHCDGQLIVLDRNNKECTVAQALGNGDKFRATDKRVVDSLRAICADLEGSSSPLPKVAHNLGFYFSPDLTQFAKLPVELAPHWPVVSTQNNEKWPDRLVASLRPIHKYSRACIGAGYMVGPSVFLGTPGVVSYYLTKFVKGGAQVLPETVFSTGRIEVDCREYLDDREREVAASLPHGFIGDVKGTTVGGCHHVTSRYLPRVLPKESVAVVGVSSPGKAAKALCTLTDVYLPDLEAYLHPETQSKCWKMMLDFKEVRLMVWKDKTAYFQLEGRYFTWYQLASYASYIRVPVNSTVYLDPCMGPALCNRRVVGSTHWGADLAVTPYDYGAKIILSSAYHGEMPPGYKILACAEFSLDDPVKYKHTWGFESDTAYLYEFTGNGEDWEDYNDAFRARQEGKIYKATATSLKFYFPPGPVIEPTLGLN

SEQ ID NO: 147 - protein, 3961 aa, Porcine reproductive and respiratory syndrome virus
MSGILDRCTCTPNARVFVAEGQVYCTRCLSARSLLPLNLQVSELGVLGLFYRPEEPLRWTLPRAFPTVECSPAGACWLSAIFPIARMTSGNLNFQQRMVRVAAEIYRAGQLTPAVLKALQVYERGCRWYPIVGPVPGVAVFANSLHVSDKPFPGATHVLTNLPLPQRPKPEDFCPFECAMATVYDIGHDAVMYVAEGKISWAPRGGDEVKFEAVPGELKLIANRLRTSFPPHHAVDMSKFAFTAPGCGVSMRVERQHGCLPADTVPEGNCWWSLFDLLPLEVQDKEIRHANQFGYQTKHGVSGKYLQRRLQVNGLRAVTDSNGPIVVQYFSVKESWIRHLKLAGEPSYSGFEDLLRIRVEPNTSPLANTEGKIFRFGSHKWYGAGKRARKARSCATATVAGRALSVRETRQAKEHEVAGADKAEHLKHYSPPAEGNCGWHCISAIANRMVNSIFETTLPERVRPPDDWATDDDLANAIQILRLPAALDRNGACTSAKYVLKLEGEHWTVTVTPGMSPSLLPLECVQGCCEHKGGLGSPDAIEVSGFDPACLDWLAEVMHLPSSAIPAALAEMSGDSDRSASPVTTVWTVSQFFARHSGGNHPDQVRLGKIISLCQVIEDCCCSQNKTNRVTPEEVAAKIDLYLRGATNLEECLARLEKARPPRVIDTSFDWDVVLPGVEAATQTNKLPQVNQCRALVPVVTQKSLDNNSVPLTAFSLANYYYRAQGDEVRHRERLTAVLSKLEEVVREEYGLMPTEPGPRPTLPRGLDELKDQMEEDLLRLANAQATSDMMAWAVEQVDLKTWVKNYPRWTPPPPPPKVQPRKTKPVKSLPERKPVPAPRRKVGPDCGSPVSLGGDVPNSWEDLAVSSPLDLPTPPEPATLSSELVIVSSPQCIFRPATPLSEPAPIPAPRGTVSRPVTPLSEPIPVPAPRRKFQQVKRLSSAAAVPLHQNEPLDLSASSQTEYEASPSAPPQSGGVLGVEGHEAEETLSEISDMSGNIKPASVSSSSSLSSVEITRPKYSAQAIIDSGGPCSGHLQGVKETCLSVMREACDATKLDDPATQEWLSRMWDRVDMLTWRNTSVCQAIRTLDGRLKFLPKMILETPPPYPCEFVMMPHTPAPSVGAESDLTIGSVATEDVPRILEKIENVGEMANQEPSAFSEDKPVDDQLVNDPRISSRRPDESTAAPSAGTGGAGSFTDLPSSDGADADGGGPFRTAKRKAERLFDQLSRQVFDLVSHLPVFFSRLFHPGGGYSTGDWGFAAFTLLCLFLCYSYPAFGIAPLLGVFSGTSRRVRMGVFGCWLAFAVGLFKPVSDPVGAACEFDSPECRNILLSFELLKPWDPVRSLVVGPVGLGLAILGRLLGGARCIWHFLLRLGIVADCILAGAYVLSQGRCKKCWGSCIRTAPNEVAFNVFPFTRATRSSLIDLCDRFCAPKGMDPIFLATGWRGCWAGRSPIEQPSEKPIAFAQLDEKKITARTVVAQPYDPNQAVKCLRVLQAGGAMVAEAVPKVVKVSAVPFRAPFFPTGVKVDPDCRVVVDPDTFTAALRSGYSTTNLVLGVGDFAQLNGLKIRQISKPSGGGPHLMAALHVACSMALHMLTGIYVTAVGSCGTGTNDPWCANPFAVPGYGPGSLCTSRLCISQHGLTLPLTALVAGFGIQEIALVVLIFVSIGGMAHRLSCKADMLCILLAIASYVWVPLTWLLCVFPCWLRCFSLHPLTILWLVFFLISVNMPSGILAMVLLVSLWLLGRYTNVAGLVTPYDIHHYTSGPRGVAALATAPDGTYLAAVRRAALTGRTMLFTPSQLGSLLEGAFRTRKPSLNTVNVIGSSMGSGGVFTIDGKVKCVTAAHVLTGNSARVSGVGFNQMLDFDVKGDFAIADCPNWQGAAPKAQFCADGWTGRAYWLTSSGVEPGVIGKGFAFCFTACGDSGSPVITEAGELVGVHTGSNKQGGGIVTRPSGQFCNVAPIKLSELSEFFAGPKVPLGDVKVGSHIIKDISEVPSDLCALLAAKPELEGGLSTVQLLCVFFLLWRMMGHAWTPLVAVSFFILNEVLPAVLVRSVFSFGMFVLSWLTPWSAQILMIRLLTAALNRNRWSLAFFSLGAVTGFVADLAATQGHPLQAVMNLSTYAFLPRMMVVTSPVPVITCGVVHLLAIILYLFKYRGLHQILVGDGVFSAAFFLRYFAEGKLREGVSQSCGMNHESLTGALAMRLNDEDLDFLMKWTDFKCFVSASNMRNAAGQFIEAAYAKALRVELAQLVQVDKVRGVLAKLEAFADTVAPQLSPGDIVVALGHTPVGSIFDLKVGSTKHTLQAIETRVLAGSKMTVARVVDPTPTPPPAPVPIPLPPKVLENGPNAWGDEDRLNKKKRRRMEALGIYVMGGKKYQKFWDKNSGDVFYEEVHNNTDEWECLRVGDPADFDPEKGTLCGHVTIENKAYHVYISPSGKKFLVPVNPENGRVQWEAAKLSMEQALGMMNVDGELTAKELEKLKRIIDKLQGLTKEQCLNCLLAASGLTRCGRGGLVVTETAVKIVKFHNRTFTLGPVNLKVASEVELKDAVEHNQHPVARPIDGGVVLLRSAVPSLIDVLISGADASPKLLAHHGPGNTGIDGTLWDFESEATKEEVALSAQIIQACDIRRGDAPKIGLPYKLYPVRGNPERVKGVLQNTRFGDIPYKTPSDTGSPVHAAACLTPNATPVTDGRSVLATTMPPGFELYVPTIPASVLDYLDSRPDCPKQLTEHGCEDAALKDLSKYDLSTQGFVLPGVLRLVRKYLFAHVGKCPPVHRPSTYPAKNSMAGINGNRFPTKDIQSVPEIDVLCAQAVRENWQTVTPCTLKKQYCGKKKTRTILGTNNFIALAHRAALSGVTQGFMKKAFNSPIALGKNKFKELQTSVLGRCLEADLASCDRSTPAIVRWFAANLLYELACAEEHLPSYVLNCCHDLLVTQSGAVTKRGGLSSGDPITSVSNTIYSLVIYAQHMVLSYFKSGHPHGLLFLQDQLKFEDMLKVQPLIVYSDDLVLYAESPTMPNYHWWVEHLNLMLGFQTDPKKTAITDSPSFLGCRIINGRQLVPNRDRILAALAYHMKASNVSEYYASAAAILMDSCACLEYDPEWFEELVVGIAQCARKDGYSFPGTPFFMSMWEKLRSNYEGKKSRVCGYCGAPAPYATACGLDVCIYHTHFHQHCPVTIWCGHPAGSGSCSECKSPVGKGTSPLDEVLEQVPYKPPRTVIMHVEQGLTPLDPGRYQTRRGLVSVRRGIRGNEVELPDGDYASTALLPTCKEINMVAVASNVLRSRFIIGPPGAGKTYWLLQQVQDGDVIYTPTHQTMLDMIRALGTCRFNVPAGTTLQFPVPSRTGPWVRILAGGWCPGKNSFLDEAAYCNHLDVLRLLSKTTLTCLGDFKQLHPVGFDSHCYVFDIMPQTQLKTIWRFGQNICDAIQPDYRDKLMSMVNTTRVTYVEKPVRYGQVLTPYHRDREDDAITIDSSQGATFDVVTLHLPTKDSLNRQRALVAITRARHAIFVYDPHRQLQGLFDLPAKGTPVNLAVHRDGQLIVLDRNNKECTVAQALGNGDKFRATDKRVVDSLRAICADLEGSSSPLPKVAHNLGFYFSPDLTQFAKLPVELAPHWPVVTTQNNEKWPDRLVASLRPIHKYSRACIGAGYMVGPSVFLGTPGVVSYYLTKFVKGEAQLLPETVFSTGRIEVDCREYLDDREREVAASLPHAFIGDVKGTTVGGCHHVTSRYLPRVLPKESVAVVGVSSPGKAAKALCTLTDVYLPDLEAYLHPETQSKCWKMMLDFKEVRLMVWRDKTAYFQLEGRYFTWYQLASYASYIRVPVNSTVYLDPCMGPALCNRRVVGSTHWGADLAVTPYDYGAKIILSSAYHGEMPPGYKILACAEFSLDDPVRYKHTWGFESDTAYLYEFTGNGEDWEDYNDAFRARQEGKIYKATATSLKFHFPPGPVIEPTLGLN

SEQ ID NO: 148 - protein, 3596 aa, Porcine reproductive and respiratory syndrome virus
MFCECPRSNLVVMCSGAFCCVLCGHRRRPRPASESDRAKYGPIVQYVEARVAHVYSGLEGRYCALEMIPITYGNKFPYCKPLPVSFVIKTLAGVQGDLTRPEETPLPGGYGVIPCWGPHLAAVGYLSPAHVGRDWFEGATHAIVHIGSYGGHERPTTIPFNTTGGDVYQLGTCTIVETIDHVEWHAGVKPGTAICPLDRIDFAQKVITAFPEGVLANKAWLGDKRGTLKVEADPETAALSFEHGRCWLKLFPDPACELTTASTFGYQLNCGVQGKYIARRLQTNGLKLVQNQEGKFIAYTFHRGSWLGHIGHADESVPPDCQIIARFDVLPYNEWSPLPLLKLPGKTYFGGNASSVSWPEWKYDEQLLYADSLTAGFCWLQLFPPLSRKSEAQRAILAQQVNNYGVTGTYLEYRLRQYGIVLAECDYGEHYIYAAASDSSIRHISPVPIHDRHHVFVTRLTARFGAFDEGFDLGFGTRYGRRRGGGKKSGQSSGVRAPGRTTPDLAGDWGKAVDDQEKTASKVTTDKAMSTSEPAVVQVGCETKPVADAAAVPASVNSTGCALLPVQADPCCTAGVAAKESEPKAVAAPSIPITFGAPAGETLPVAASPLVVKKDKRCISVKLTAKKALPKETFIPPPDGGCGVHAFAAIQYHINTGHWPEQKPVVNWAYEAWTTNEDIGHMICSTETPAALEPCLHARYVVRLDSDHWVVDHYPNRPMCFVEACAHGWCSSLLSEPTGEEGEHLVDCSALYDCLGKFRNGTEFGDTVLGLSKTAHCCNKRVPTPRKQAIMSLLNRPNCVPCIAPPSQVRTVDPSQPAAPLPPVPRPRKRKAAAQQVSKVPSEQDPSLAHDPPEKPDSVRPPKLGYLDRAWNNMLARTHKLHNLQQRVFGLYPQLLSMLLPSGARPSTPRLLGCYFSMAVAMFFLFLGSPLFILCAVLAGVIAPSARYPKILCCCLVVVYICTLFADAISSVCDNDDADCRAFLSDLGDRYSTNQPVYITPGPATFFLAVSRNFFVVSVALFPLHLLLLMVDVLLVIGVLCMDGYCFRCFSRCVRKAPEEVSLLTIPQSRVSRRFLLDICDFYSAPPVDIIRLATGLNGCFRGDYSPIGSSTSVITADKIDVKKVSCRTVCSFPSCPSEAVKVLHVLSVRGQMCAHNEQKVEKVDALPCKNPLVSIRSLLKEIVPVDSGTYEILSSIGCDMSHLVIGDGDFFKVMGVPRPSPFTVMRLRACRVVGGGRIFRTALAAAWVLFFVCAGYWVQMSTPCGIGTNDPFCKSSFGVPTYVNQGVCHGQYCASSKGVSRATSILTVRNPAVAPYIVLAACLVYLASVYVPGIIEVSLLVLNALLPAGPAISALRTLVMIIAAPHLSMKYIAFFCCTTAFVDFTSVVVVLTALLVGWILARYTGIGGFVTPYDIHDVVKSQRDGVAVANAPPNTYLGAVRRAALTGKPAFFVANNTGIVLEGLLREKTRASNSVSVYGVTCGSGGLFSDGNNTVCLTATHVCGNNKAVVDYQGTRYEAVFTTKGDYASAVVPIPGAFPPLKFAPQSYTGRAYWYANTGVETGFVGTTGCLVFSGPGDSGSPIITPDGLIVGVHTGSDSKGSGAYTTPNGLTVSGPLSLKEMGAHYEGPIVDVPTRLPRNVHNDTKSVPQPLARLLESSINLEGGLGTIQLIIVAVVLWKYAVDPLSIPFVVAFFLLNEILPKCLIRCFYNYSLFCLAAFSPLASRIFFIRLLTAALNRNPTALICHACFAGIAVLNDFIILGDIRLALRFTSFYVVGVNHDAIAIAGIGALVCVAACCLELFGLPQMASVIGCHGSFDPTFLSRYVREGKPQGVSSGIGTESLSTALACALSEDELNFLAQAVDHKAIVSAIHVHKTLQDYILSKNAKILRASLASVHANHNASKALASLDKFLQGTSTQLKPGDPVILLGSTSAELVSVFSGDSEYIAEPIRSHPVGGTICTLCVVQAKCEGGLVTQVNGKFSPAKYLAVAGKVLADHPDYKLENDGRFPRTREDRVKDSVQVDTVDIGSHTFKKMWNKTTGDVWYDIIMPESAANPLAVHDLDSAVAAIGMSKEIPEKDMNRLRAIISKLQGLVSSEALNCMLTAAGCTSADRSGLVITLDYAKIITHHARTRAFSSIDFKVVSPDEAMRTARLSPSPQPIIASFSDDKFLLLRRHPPSLLDVLTKGLDATCREPLHSPGDQGIDGYLWDFEAPHSKEAIWLSNQIISACAARRGDAPGCYPYKLHPVRGDPYRVGNVLKNTRFGDVTYTAVSDSDSPWLKVASINSGGCPVVTDRVLGSTIPVGSEIYLPTLPESVLDYLDSRPDCPTYYTQHGCEAAALQDLKKFNLSTQGFILPEVLNIVRNYLLGTIGYRPAIYKPSTVPSNDSHAGINGLSFSTKTLQALPDIDELCEKAIAEVWQTVTPVTLKKQFCSKAKTRTILGTNAMASLALRALLSGVTQGFQLAGKNSPICLGKSKFDPCTFEVKGRCLETDLASCDRSTPAIVRHFATKLLFEMACAERALPLYVVNCCHDLIVTQTSAATKRGGLSSGDPVTSIANTIYSLVLYVQHMVLTLLENGHPLSLKFLSGKLNFQDLYKLQAFIVYSDDLILLNESDDLPNFERWVPHLELALGFKVDPKKTVITSNPGFLGCEYRHGWLVPQKQRVLAALAYHVNAKDVHTYYINSTAILNDASALSAFEPDWFDDWVIGLADCARKDGYSFPGPAAFREFFSRVSGYQFEGKEVQVCSICCSTARTTSLCGMALCDFCAHRHYHPGCHVLSSFCKHVIGSNTCKMCSIPILKDRTKFAELLASDQYRSVCTVEVTVVDGYTDAAPGRYSYQKKQYMLRKERRGCPLDLPDGKYSMKLLPNSCSGICVPKAQENATLSNFVVGPPGSGKTTFISNLLDDDAVVYCPTHVSLIAYSKSLPAARFSVPRGQDPAEYGTPALSGPTLQLLSAGYVPGAKHYLDEACYANPFDVFKLLSKTPITAIGDPAQLTPVGFDTPLYVFELMKKNALHAIYRFGQNICNAIQPCYSTKLVSQRQGDTEVIFQTKFAPRGKVLTPYHRDRVGAAVTIDSSQGSTYDVVTLYLPTKGSLTLARGLVGITRARERLYVYDPHHQLAKYFNLQPSSTTIRPHAVVIDGKARVMLSDKCYAAPEDFPGMLCTARPATAADRKILEETCLKLDFLESGSLSPLPRVCYNLGFYYSPDITKLLPIPSELAKHWPVATNRNNPEWPNRLVVSATRLSPLSHPAVCAGYYVGDSLFVGTPNVTSYWLTKFLDGRAVPMEDSVYSTGRFEMDIRDYLDSAERDFAAKHPHAFIGDTKGTTVGGCHHITSQYLPHVLPADSVVKVGVSKPGVAHKALCTVTDIYLPMLGLYTSPPTQSKVYKVNVDHKACKLMVWRDQTMYFQEGFDYHTLVDALRFVRLSSDGVYRVAPELTPMIGNRRLDLGAKPLRPVDLAITPWDDPKCEFLVTHASPFDMSDEFLLVNAFDFIKEDLLGKSVTPVYFYKRLSEPLHFDQNLPPHVGAILSKAPRFISLAKVFNFCFTPTACHCKVSVKTATGDHMCKCSLSSDEFLSRFNPTVGTP

SEQ ID NO: 149 - protein, 9 aa, Porcine reproductive and respiratory syndrome virus
GKYLQRRLQ

What is claimed is:

1. A porcine reproductive and respiratory syndrome virus (PRRSV) comprising a nucleic acid encoding ORF1a or a functional part thereof, wherein said nucleic acid comprises at least one mutation resulting in reduced translation of a transframe (TF) domain of nsp2TF and/or altered translation of one or more downstream products translated from said nucleic acid, in a cell infected by said PRRSV, when compared to a wild-type of said PRRSV, wherein said mutation interferes with −2 ribosomal frameshifting at a −2 frameshifting site located in the nucleic acid sequence that codes for the nsp2 protein GGU(U/C)U(U/C)U and/or the conserved CCCANCUCC motif.

2. A PRRSV of claim 1, wherein nsp2TF function is reduced and/or absent in a cell infected by said arterivirus when compared to a wild-type of said arterivirus.

3. A PRRSV of claim 1 comprising nucleic acid encoding ORF1a or a functional part thereof, wherein the nsp2TF amino acid sequence of the arterivirus is altered, truncated or absent.

4. A PRRSV of claim 1, wherein the amino acid sequence of a TF domain of nsp2TF is modified, and wherein said modified amino acid sequence optionally provides epitopes that are absent in wild-type arterivirus, and are immunogenic, and wherein a reading frame of ORF1a is not compromised.

5. An autonomously replicative PRRSV according to claim 1.

6. A PRRSV of claim 1 wherein the PRRSV is PRRSV Type 1 (European genotype), Type II PRRSV (North American genotype), or a combination thereof.

7. An RNA, DNA, or cDNA encoding the PRRSV according to claim 1.

8. A vaccine or immunogenic composition comprising the arterivirus of claim 1, and a pharmaceutically acceptable carrier or diluent.

9. The vaccine or immunogenic composition of claim 6 comprising pSD01-08-KO1 (SEQ ID 92) pSD01-08-KO2 (SEQ ID NO:93) pSD01-08-KO3 (SEQ ID NO:94), pSD95-21-KO1(SEQ ID NO:95), pSD95-21-KO2 (SEQ ID NO:96), and pSD95-21-KO3 (SEQ ID NO:97).

10. A vaccine or immunogenic composition of claim 6, wherein the composition further comprises an adjuvant, an excipient, or a combination thereof.

11. A method of inducing an immune response to an arterivirus in an animal, comprising administering to an animal an effective amount of the composition of claim 6.

* * * * *